US011236347B2

(12) United States Patent
Anand et al.

(10) Patent No.: US 11,236,347 B2
(45) Date of Patent: Feb. 1, 2022

(54) OCHROBACTRUM-MEDIATED TRANSFORMATION OF PLANTS

(71) Applicants: PIONEER HI-BRED INTERNATIONAL, INC., Johnston, IA (US); E. I. DU PONT DE NEMOURS AND COMPANY, Wilmington, DE (US)

(72) Inventors: Ajith Anand, West Des Moines, IA (US); Steven Henry Bass, Hillsborough, CA (US); Sean M. Bertain, Oakland, CA (US); Hyeon-Je Cho, Fremont, CA (US); Anthony J. Kinney, Wilmington, DE (US); Theodore M. Klein, Wilmington, DE (US); Michael Lassner, Portland, OR (US); Kevin E. McBride, Davis, CA (US); York Moy, San Francisco, CA (US); Barbara Ann Marie Rosen, Mountain View, CA (US); Jun-Zhi Wei, Hayward, CA (US)

(73) Assignees: PIONEER HI-BRED INTERNATIONAL, INC.; E. I. DU PONT DE NEMOURS AND COMPANY

( * ) Notice: Subject to any disclaimer, the term of this patent is extended or adjusted under 35 U.S.C. 154(b) by 651 days.

(21) Appl. No.: 15/756,023

(22) PCT Filed: Aug. 26, 2016

(86) PCT No.: PCT/US2016/049135
§ 371 (c)(1),
(2) Date: Feb. 27, 2018

(87) PCT Pub. No.: WO2017/040343
PCT Pub. Date: Mar. 9, 2017

(65) Prior Publication Data
US 2018/0216123 A1 Aug. 2, 2018

Related U.S. Application Data

(60) Provisional application No. 62/211,267, filed on Aug. 28, 2015.

(51) Int. Cl.
C12N 15/82 (2006.01)
C07K 14/195 (2006.01)
C12N 15/65 (2006.01)

(52) U.S. Cl.
CPC ........ *C12N 15/8205* (2013.01); *C07K 14/195* (2013.01); *C12N 15/65* (2013.01); *C12N 15/8202* (2013.01); *C12N 15/8243* (2013.01)

(58) Field of Classification Search
None
See application file for complete search history.

(56) References Cited

U.S. PATENT DOCUMENTS

| 5,073,675 A | 12/1991 | Jones et al. |
| 6,265,638 B1 | 7/2001 | Bidney et al. |
| 6,372,963 B1 | 4/2002 | D'Halluin |
| 8,273,954 B1 | 9/2012 | Rogers et al. |
| 8,298,819 B2 | 10/2012 | Takakura et al. |
| 8,334,139 B1 | 12/2012 | Fraley et al. |
| 8,338,665 B2 | 12/2012 | Gilbertson et al. |
| 9,267,144 B2 | 2/2016 | Sidorov et al. |
| 9,617,551 B2 | 4/2017 | Merlo et al. |
| 2007/0074314 A1 | 3/2007 | Ye et al. |
| 2007/0271627 A1* | 11/2007 | Ye ............ C12N 15/8202 800/278 |
| 2009/0075358 A1 | 3/2009 | Cambia |
| 2010/0005547 A1 | 1/2010 | Gelvin et al. |
| 2012/0073015 A1 | 3/2012 | Martinell et al. |
| 2014/0059718 A1 | 2/2014 | Campanoni |
| 2015/0184171 A1 | 7/2015 | D'Halluin |
| 2016/0083737 A1 | 3/2016 | Imayama et al. |
| 2017/0137833 A1 | 5/2017 | Hamada et al. |

FOREIGN PATENT DOCUMENTS

| EP | 2980214 | | 3/2014 |
| WO | 2000018939 | A1 | 4/2000 |
| WO | 2006/004914 | A2 | 1/2006 |
| WO | 2007/137075 | A2 | 11/2007 |
| WO | 2008112645 | A2 | 9/2008 |
| WO | 2012/016222 | A2 | 2/2012 |

(Continued)

OTHER PUBLICATIONS

Nester (Frontiers in plant science 5 (2015): 730). (Year: 2015).*
Alvarez-Martinez et al. (Microbiology and Molecular Biology Reviews 73.4 (2009): 775-808). (Year: 2009).*
Perri, et al. (Journal of Biological Chemistry 266.19 (1991): 12536-12543). (Year: 1991).*
Gen Bank Accession JQ755431 dated Jun. 4, 2012. (Year: 2012).*
Gen Bank Accession AF139061, dated Sep. 23, 1999. (Year: 1999).*
Rivas, et al. (Microbiology Insights 2 (2009): MBI-S3137). (Year: 2009).*
Lyutzkanova, et al. (Microbiology 143.7 (1997): 2135-2143). (Year: 1997).*

(Continued)

*Primary Examiner* — Charles Logsdon

(57) ABSTRACT

Methods and compositions for *Ochrobactrum*-mediated transformation of plants are provided. Methods include but are not limited to using an *Ochrobactrum* strain to transfer a polynucleotide of interest to a plant cell. These include VirD2-dependent methods. Compositions include an *Ochrobactrum* strain, transfer DNAs, constructs and/or plasmids. These include *Ochrobactrum* strains having a plasmid comprising one or more virulence gene(s), border region, and/or origin of replication. Plant cells, tissues, plants, and seeds comprising a polynucleotide of interest produced by the methods are also provided.

124 Claims, 8 Drawing Sheets
(1 of 8 Drawing Sheet(s) Filed in Color)
Specification includes a Sequence Listing.

(56) References Cited

FOREIGN PATENT DOCUMENTS

| WO | 2013/032985 A1 | 3/2013 |
|---|---|---|
| WO | 2014/157541 A1 | 10/2014 |

OTHER PUBLICATIONS

Hodges, et al. (Journal of bacteriology 186.10 (2004): 3065). (Year: 2004).*
Ayres, et al. (Journal of bacteriology 177.10 (1995): 2789). (Year: 1995).*
Gen Bank Accession L05507 (1990). (Year: 1990).*
Batt, Sarah M., et al.: "Bacterial Genome Partitioning: N-Terminal Domain of IncC Protein Encoded by Broad-Host-Range Plasmid RK2 Modulates Oligomerisation and DNA Binding", Journal of Molecular Biology, 2009, vol. 385, pp. 1361-1374.
Bevan, Michael: "A chimaeric antibiotic resistance gene as a selectable marker for plant cell transformation", Nature, Jul. 14, 1983 (Jul. 14, 1983), vol. 304, No. 22, pp. 184-187.
Bevan, Michael: "Binary Agrobacterium vectors for plant transformation", Nucleic Acids Research, 1984, vol. 12, No. 22, pp. 8711-8721.
Bolivar, Francisco, et al.: "Construction and Characterization of New Cloning Vehicles I. Ampicillin-resistant derivatives of the plasmid pMB9", Gene, 1977, vol. 2, pp. 75-93.
Bolivar, Francisco, et al.: "Construction and Characterization of New Cloning Vehicles II. A multipurpose cloning system", Gene, 1977, vol. 2, pp. 95-113.
Broothaerts, Wim, et al.: "Gene transfer to plants by diverse species of bacteria", Nature, Nature Publishing Group, Feb. 10, 2005 (Feb. 10, 2005), vol. 433, No. 7026, pp. 629-633.
Buchanan-Wollaston, Vicky, et al.: "The mob and oriT mobilization functions of a bacterial plasmid promote its transfer to plants", Nature, Jul. 9, 1987 (Jul. 9, 1987), vol. 328, pp. 172-175.
Chen, Yurong, et al.: High throughput Agrobacterium tumefaciens-mediated germline transformation of mechanically isolated meristem explants of cotton (*Gossypium hirsutum* L.), Plant Cell Rep, 2014, vol. 33, pp. 153-164.
Chilton, Mary-Dell: "Adding diversity to plant transformation", Nature, Mar. 2005 (Mar. 2005), vol. 23, No. 3, pp. 309-310.
Chung, Sang-Min, et al.: "Agrobacterium is not alone: gene transfer to plants by viruses and other bacteria", Trends in Plant Science, Jan. 2006 (Jan. 2006), vol. 11, No. 1.
Day, Anil, et al.: "The chloroplast transformation toolbox: selectable markers and marker removal", Plant Biotechnology, 2011, vol. 9, pp. 540-553.
De Framond, Annick J., et al.: "Mini-Ti: a new vector strategy for plant genetic engineering", BioTechnology, May 1983 (May 1983), vol. 5, pp. 262-269.
Garfinkel, David J., et al.: "Genetic Analysis of Crown Gall: Fine Structure Map of the T-DNA by Site-Directed Mutagenesis", Cell, Nov. 1981 (Nov. 1981), vol. 27, pp. 143-153.
Gelvin, Stanton B.: "Gene exchange by design", Nature, Feb. 10, 2005 (Feb. 10, 2005), vol. 433, pp. 583-584.
Goldschmidt-Clermont, Michel, "Transgenic expression of aminoglycoside adenine transferase in the chloroplast: a selectable marker for site-directed transformation of chlamydomonas", Nucleic Acids Research, 1991, vol. 19, No. 15, pp. 4083-4089.
Heeb, Stephan, et al.: "Small, Stable Shuttle Vectors Based on the Minimal pVS1 Replicon for Use in Gram-Negative, Plant-Associated Bacteria", Molecular Plant Microbe Interactions, 2000, vol. 13, No. 2, pp. 232-237.
Hodges, L.D., et al.: "Agrobacterium rhizogenes GALLS Protein Contains Domains for ATP Binding, Nuclear Localization, and Type IV Secretion", Journal of Bacteriology; Dec. 1, 2006 (Dec. 1, 2006), vol. 188, No. 23, pp. 8222-8230.
Hoekema, A., et al.: "A binary plant vector strategy based on separation of vir- and T-region of the Agrobacterium tumefaciens Ti-plasmid", Nature, 1983, vol. 303, pp. 179-180.

Holmes, B., et al.: "*Ochrobactrum anthropi* gen. nov., sp. nov. from Human Clinical Specimens and Previously Known as Group Vd", International Journal of Systematic Bacteriology, Oct. 1988 (Oct. 1988), vol. 38, No. 4, pp. 406-416.
Hooykaas, Paul J. J., et al.: "Transfer of the Agrobacterium tumefaciens TI Plasmid to Avirulent Agrobacteria and to Rhizobium ex planta", Journal of General Microbiology, 1977, vol. 98, pp. 477-484.
Hooykaas, Paul J. J., et al.: "Agrobacterium and plant genetic engineering", Plant Molecular Biology, 1992, vol. 19, pp. 15-38.
Klapwijk, Pieter M., et al.: "Transposition of Tn904 Encoding Streptomycin Resistance into the Octopine Ti Plasmid of Agrobacterium tumefaciens", Journal of Bacteriology, Jan. 1980 (Jan. 1980), vol. 141, No. 1, pp. 129-136.
Lazo, Gerard R., et al.: "A DNA Transformation-Competent *Arabidopsis* Genomic Library in Agrobacterium", Biotechnology, 1991, vol. 10, pp. 963-967.
Lyutzkanova, Dimitrina, et al.: "A spectinomycin resistance determinant from the spectinomycin producer Streptomyces flavopersicus", Microbiology, 1997, vol. 143, pp. 2135-2143.
McBride, Kevin E., et al.: "Improved binary vectors for Agrobacterium-mediated plant transformation", Plant Molecular Biology, 1990, vol. 14, pp. 269-276.
Murai, Norimoto: "Review: Plant Binary Vectors of Ti Plasmid in Agrobacterium tumefaciens with a Broad Host-Range Replicon of pRK2, pRi, pSa or pVS1", American Journal of Plant Sciences, 2013, vol. 4, pp. 932-939.
Ooms, Gerg, et al.: "Octopine Ti-Plasmid Deletion Mutants of Agrobacterium tumefaciens with Emphasis on the Right Side of the T-Region", Plasmid, 1982, vol. 7, pp. 15-29.
Patel, Urmi, et al.: "*Rhizobia* species: A Boon for 'Plant Genetic Engineering'", Indian J Microbiology, 2011, vol. 51, No. 4, pp. 521-527.
Perri, Silvia, et al.: "Interactions of Plasmid-encoded Replication Initiation Proteins with the Origin of DNA Replication in the Broad Host Range Plasmid RK2", The Journal of Biological Chemistry, Jul. 5, 1991 (Jul. 5, 1991), vol. 266, No. 19, pp. 12536-12543.
Poteete, Anthony R., et al.: "Gentamicin and other cassettes for chromosomal gene replacement in *Escherichia coli*", BioTechniques, Sep. 2006 (Sep. 2006), vol. 41, pp. 261-264.
Suter, Todd M. et al.: "Isolation of a Gene Encoding a Novel Spectinomycin Phosphotransferase from Legionella pneumophila", Antimicrobial Agents and Chemotherapy, Jun. 1997 (Jun. 2007), vol. 41, No. 6, pp. 1385-1388.
Van Veen, R. J. M., et al.: "Crown Gall Tumor and Root Nodule Formation by the Bacterium Phyllobacterium myrsinacearum after the Introlduction of an Agrobacterium Ti Plasmid or a Rhizobium Sym Plasmid", Molecular Plant-Microbe Interactions, 1988, vol. 1, No. 6, pp. 231-234.
Weller, S. A., et al.: "Acquisition of an Agrobacterium Ri plasmid and pathogenicity by other alpha-Proteobacteria in cucumber and tomato crops affected by root mat" Applied and Environmental Microbiology, American Society for Microbiology, May 1, 2004 (May 1, 2004), vol. 70, No. 5, pp. 2779-2785.
Weller, S. A., et al.: "Induction of root-mat symptoms on cucumber plants by Rhizobium, but not by Ochrobactrum or Sinorhizobium, harbouring a cucumopine Ri plasmid", Plant Pathology, 2005, vol. 54, No. 6, pp. 799-805.
Weller, S.A., et al.: "Recurrent outbreaks of root mat in cucumber and tomato are associated with a monomorphic, cucumopine, Ri-plasmid harboured by various Alphaproteobacteria", FEMS, 2006, vol. 258, pp. 136-143.
Wendt, Toni, et al.: "Gene transfer into Solanum tubersosum via *Rhizobium* spp.", Transgenic Research, Kluwer Academic Publishers-Plenum Publishers, Jun. 27, 2010 (Jun. 27, 2010), vol. 20, No. 2, pp. 377-386.
Young, Calvin, et al.: "Association of the VirD2 Protein with the 5' End of T Strands in Agrobacterium tumefaciens", Journal of Bacteriology, Aug. 1988 (Aug. 1988), vol. 170, No. 8, pp. 3367-3374.
Zambryski, P., et al.: "Ti plasmid vector for the introduction of DNA into plant cells without alteration of their normal regeneration capacity", The EMBO Journal, 1983, vol. 2, No. 12, pp. 2143-2150.

(56) References Cited

OTHER PUBLICATIONS

Zhi, Li, et al.: "Effect of Agrobacterium strain and plasmid copy number on transformation frequency, event quality and usable event quality in an elite maize cultivar", Plant Cell Report, 2015, vol. 34, pp. 745-754.

International Search Report and Written Opinion, International Application No. PCT/US2016/049132 dated Jan. 12, 2016.

International Search Report and Written Opinion, International Application No. PCT/US2016/049135, dated Dec. 1, 2016.

Hiei, Yukoh, et al.: "Efficient transformation of rice (*Oryza sativa* L.) mediated by Agrobacterium and sequence analysis of the boundaries of the T-DNA", The Plant Journal, 1994, vol. 6, No. 2, pp. 271-282.

Ishida, Yuji, et al.: "High efficiency transformation of maize (*Zea mays* L.) mediated by Agrobacterium tumefaciens", Nature Biotechnology, Feb. 28, 1996 (Feb. 28, 1996), vol. 14, pp. 745-750.

Komari, Toshihiko, "Transformation of cultured cells of Chenopodium quinoa by binary vectors that carry a fragment of DNA from the virulence region of pTiBo542", Plant Cell Reports, 1990, vol. 9, No. 6, pp. 303-306.

Komari, Toshihiko, et al.: "Vectors carrying two separate T-DNAs for co-transformation of higher plants mediated by Agrobacterium tumefaciens and segregation of transformants free from selection markers", The Plant Journal, 1996 vol. 10, pp. 165-174.

Luo, Zhao-Qing, et al.: "Cloning and characterization of a tetracycline resistance determinant present in Agrobacterium tumefaciens C58", Journal of Bacteriology, Jan. 1999 (Jan. 1999), vol. 181, No. 2, pp. 618-626.

\* cited by examiner

OCHROBACTRUM-MEDIATED TRANSFORMATION OF PLANTS

FIELD OF DISCLOSURE

The present disclosure relates to the field of plant biotechnology. In particular, the disclosure relates to methods for producing transgenic plants and plant cells using bacterial-mediated delivery.

CROSS-REFERENCE TO RELATED APPLICATIONS

This application claims priority to U.S. Provisional Application No. 62/211,267, filed Aug. 28, 2015, which is hereby incorporated herein in its entirety by reference.

REFERENCE TO A SEQUENCE LISTING SUBMITTED AS A TEXT FILE VIA EFS-WEB

The official copy of the sequence listing is submitted electronically via EFS-Web as an ASCII formatted sequence listing with a file named 20160826_6502WOPCT_SeqList.txt, created on Aug. 24, 2016, and having a size of 861 KB and is filed concurrently with the specification. The sequence listing contained in this ASCII formatted document is part of the specification and is herein incorporated by reference in its entirety.

BACKGROUND

First introduced in 1997, genetically modified (GM) crops in 2014 represented about 80-94% of the total acreage planted in the United States. Worldwide, the global hectares of GM crops have increased over 100-fold from 1996 to 2013, with 1.7 million hectares planted in 1996 and over 175 million hectares planted in 2013. Modified crops have been adopted in about 30 countries worldwide. Many, if not most of genetically modified crops were generated using *Agrobacterium*-mediated transformation to integrate the trait(s) of interest. However there are still many challenges with using *Agrobacterium*-mediated transformation, including required modifications to *Agrobacterium*, genotype-independent transformation of some economically important plants, as well as problems consistently obtaining predictable and stable expression of transgenes. While *Agrobacterium* has been the primary vehicle for bacterial-mediated transformation of plants, it is not equally effective for all plants of interest. Studies indicate that other bacteria can also be used for plant transformation. For example, U.S. Pat. No. 7,888,552B2 describes the use of non-*agrobacterium* species for transformation of plants.

To date, other bacterial strains have typically had significantly lower transformation efficiencies compared to *Agrobacterium* under the conditions used in plants tested. Therefore there is a need for additional non-*Agrobacterium* bacterial strains and methods for the transformation of plants, and for improving plant transformation efficiencies.

SUMMARY

Methods and compositions for *Ochrobactrum*-mediated transformation of plants are provided. Methods include, but are not limited to, using an *Ochrobactrum* strain to transfer a polynucleotide of interest to a plant cell. These methods include VirD2-dependent methods. Compositions include an *Ochrobactrum* strain, transfer DNAs, and constructs and/or plasmids. These compositions include *Ochrobactrum* strains having a plasmid comprising one or more virulence gene(s), border region, and/or origin of replication. Plant cells, tissues, plants, and seeds comprising a polynucleotide of interest produced by the methods are also provided.

One aspect of the disclosure features an isolated *Ochrobactrum haywardense* H1, wherein said *Ochrobactrum* is deposited under NRRL B-67078.

In an aspect, the *Ochrobactrum* further comprises: (a) a first nucleic acid comprising a vir gene region of a Ti plasmid wherein the vir gene region acts to introduce a nucleic acid coding for a sequence of interest into a plant cell in a VirD2-dependent manner; and (b) a second nucleic acid comprising one or more T-DNA border sequence(s) operably linked to a sequence of interest.

In an aspect, the first nucleic acid and the second nucleic acid are on a single polynucleotide molecule.

In another aspect, the first nucleic acid and the second nucleic acid are on separate polynucleotide molecules.

In another aspect, the *Ochrobactrum* further comprises a selectable marker.

Another aspect features a method of producing a transformed plant cell, the method comprising: (a) contacting a plant cell with an *Ochrobactrum* comprising a first nucleic acid, wherein the first nucleic acid comprises a vir gene region of a Ti plasmid, and a second nucleic acid, wherein the second nucleic acid comprises one or more T-DNA border sequence(s) operably linked to a sequence of interest; (b) culturing the plant cell under conditions allowing *Ochrobactrum* to transfer the sequence of interest to the plant cell; and (c) identifying a transformed plant cell comprising the sequence of interest in its genome.

In an aspect, the method further comprises regenerating a plant comprising the sequence of interest in its genome.

In an aspect, the plant cell is from a monocot or a dicot.

In an aspect, the plant cell is from a plant selected from the group consisting of soybean, tobacco, sunflower, *Arabidopsis*, safflower, alfalfa, corn, wheat, rice, sorghum, barley, oats, millet, canola, *Brassica*, cotton, and sugarcane.

In another aspect, the *Ochrobactrum* is grown in the presence of acetosyringone or other compound that induces vir gene function prior to contacting the plant cell.

In another aspect, the plant cell is comprised in an explant from a plant seed, seedling, callus, cell suspension, cotyledon, meristem, leaf, root, or stem; and the explant is contacted with the *Ochrobactrum*.

In another aspect, the explant comprises an embryonic meristem, a somatic meristem, callus, cell suspension, a cotyledon, a cotyledonary node, or comprises tissue from a leaf, a root, or a stem.

In an aspect, the identifying a plant cell comprising the sequence of interest is carried out in the absence of a selection agent.

In another aspect, the identifying a plant cell comprising the sequence of interest comprises culturing the plant cell in the presence of a selection agent, wherein the sequence of interest confers tolerance to the selection agent or is codelivered with a selectable marker that confers tolerance to the selection agent.

In another aspect, the selection agent is glyphosate, kanamycin, bialaphos, 2,4-D, or dicamba.

In another aspect, the sequence of interest is not physically linked to a selectable marker gene.

In another aspect, the marker gene and the sequence of interest genetically segregate in progeny of a plant regenerated from the plant cell comprising the sequence of interest.

In another aspect, the *Ochrobactrum* further comprises a third nucleic acid comprising a second sequence of interest, and whereby the transformed cell comprises the second sequence of interest in its genome.

In another aspect, regenerating a plant from the plant cell comprises inducing formation of one or more shoots from an explant comprising the plant cell and cultivating at least a first shoot into a whole fertile plant.

In another aspect, regeneration occurs by organogenesis.

In another aspect, the *Ochrobactrum* is selected from the group consisting of *Ochrobactrum haywardense* H1, *Ochrobactrum cytisi*, *Ochrobactrum daejeonense*, *Ochrobactrum lupine*, *Ochrobactrum oryzae*, *Ochrobactrum tritici*, LBNL 124-A-10, HTG3-C-07 and *Ochrobactrum pectoris*.

In an aspect wherein the Rhizobiaceae virulence gene a r-virF virulence gene has SEQ ID NO: 99, or variants and derivatives thereof.

In an aspect, the origin of replication for propagation and stable maintenance in *Ochrobactrum* is derived from the pBBR1 origin of replication.

An aspect of the disclosure provides an isolated *Ochrobactrum haywardense* H1, wherein said *Ochrobactrum* is deposited under NRRL B-67078.

In another aspect, the disclosure provides *Ochrobactrum haywardense* H1 comprising a vector in operable linkage comprising: (a) a first nucleic acid comprising a vir gene region, wherein the vir gene region acts to introduce a nucleic acid coding for a sequence of interest into a plant cell in a VirD2-dependent manner; and (b) a second nucleic acid comprising one or more T-DNA border sequence(s) operably linked to a sequence of interest. In an aspect, the first nucleic acid and the second nucleic acid are on a single polynucleotide molecule. In an aspect, the first nucleic acid and the second nucleic acid are on separate polynucleotide molecules. In an aspect, the *Ochrobactrum* further comprises a selectable marker gene. In an aspect, the selectable marker gene provides resistance to gentamicin, neomycin/kanamycin, hygromycin, or spectinomycin. In an aspect, the selectable marker gene is an aacC1 gene, a npt1 gene, a npt2 gene, a hpt gene, a SpcN gene, an aph gene or an aadA gene. In an aspect, the selectable marker gene is an aacC1 gene. In an aspect, the aacC1 gene has SEQ ID NO: 1, or variants and fragments thereof. In an aspect, the selectable marker gene is an aadA gene. In an aspect, the aadA gene has SEQ ID NO: 39, or variants and fragments thereof. In an aspect, the selectable marker gene is a npt1 gene. In an aspect, the npt1 gene has SEQ ID NO: 40, or variants and fragments thereof. In an aspect, the selectable marker gene is a npt2 gene. In an aspect, the npt2 gene has SEQ ID NO: 41, or variants and fragments thereof. In an aspect, the selectable marker gene is a hpt gene. In an aspect, the hpt gene has SEQ ID NO: 67, or variants and fragments thereof. In an aspect the selectable marker gene is the SpcN gene having SEQ ID NO: 77, or variants and fragments thereof. In an aspect the selectable marker gene is the aph gene having SEQ ID NO: 78, or variants and fragments thereof. In an aspect, the selectable marker gene is not a tetracycline selectable marker gene. In an aspect, the selectable marker gene is not a tetAR gene. In an aspect, the selectable marker gene is a counter-selectable marker gene. In an aspect, the counter-selectable marker gene is a sacB gene, a rpsL (strA) gene, a pheS gene, a dhfr (folA) gene, a lacY gene, a Gata-1 gene, a ccdB gene, or a thyA− gene. In an aspect, the vir gene region comprises Rhizobiaceae virulence genes virB1-virB11 having SEQ ID NOS: 4-14, respectively, or variants and derivatives thereof or r-virB1-B11 having SEQ ID NOS: 80-90, respectively, or variants and derivatives thereof, wherein the vector comprising the virulence genes r-virB1-B11 further comprises a r-galls virulence gene having SEQ ID NO: 101, or variants and derivatives thereof. In an aspect, the vir gene region comprises Rhizobiaceae virulence genes virC1-C2 having SEQ ID NOS: 16-17, respectively, or variants and derivatives thereof or r-virC1-C2 having SEQ ID NOS: 92-93, respectively, or variants and derivatives thereof, wherein the vector comprising the virulence genes r-virC1-C2 further comprises a r-galls virulence gene having SEQ ID NO: 101, or variants and derivatives thereof. In an aspect, the vir gene region comprises Rhizobiaceae virulence genes virD1-D2 having SEQ ID NOS: 18-19, respectively, or variants and derivatives thereof or r-virD1-D2 having SEQ ID NOS: 94-95, respectively, or variants and derivatives thereof, wherein the vector comprising the virulence genes r-virD1-D2 further comprises a r-galls virulence gene having SEQ ID NO: 101, or variants and derivatives thereof. In an aspect, the vir gene region comprises Rhizobiaceae virulence gene virG having SEQ ID NO: 15, or variants and derivatives thereof or a r-virG virulence gene having SEQ ID NO: 91, or variants and derivatives thereof, wherein the vector comprising the virulence gene r-virG further comprises a r-galls virulence gene having SEQ ID NO: 101, or variants and derivatives thereof. In an aspect, the vir gene region comprises one or more Rhizobiaceae virulence genes virA, virD3, virD4, virD5, virE1, virE2, virE3, virH, virH1, virH2, virK, virL, virM, virP, virQ, r-virA, r-virD3, r-virD4, r-virD5, r-virE3, or r-virF or variants and derivatives thereof, wherein the vector comprising the virulence genes r-virA, r-virD3, r-virD4, r-virD5, r-virE3, or r-virF further comprises a r-galls virulence gene having SEQ ID NO: 101, or variants and derivatives thereof. In an aspect, the Rhizobiaceae virulence gene is virA having SEQ ID NO: 26, or variants and derivatives, or a r-virA virulence gene having SEQ ID NO: 79, or variants and derivatives thereof, wherein the vector comprising the virulence gene r-virA further comprises a r-galls virulence gene having SEQ ID NO: 101, or variants and derivatives thereof. In an aspect, the Rhizobiaceae virulence genes virD3-D5 have, respectively, SEQ ID NOS: 20-22, or variants and derivatives thereof or the r-virD3-D5 virulence genes having SEQ ID NO: 96-98, respectively, or variants and derivatives thereof, wherein the vector comprising the virulence gene r-virD3-D5 further comprises a r-galls virulence gene having SEQ ID NO: 101, or variants and derivatives thereof. In an aspect, the Rhizobiaceae virulence genes virE1-E3 have, respectively, SEQ ID NOS: 23-25, or variants and derivatives thereof or a r-virE3 virulence gene having SEQ ID NO: 100, or variants and derivatives thereof, wherein the vector comprising the virulence gene r-virE3 further comprises a r-galls virulence gene having SEQ ID NO: 101, or variants and derivatives thereof. In an aspect, the Rhizobiaceae virulence genes virH-H1 have, respectively, SEQ ID NOS: 42-43, or variants and derivatives thereof. In an aspect, the Rhizobiaceae virulence gene virK has SEQ ID NO: 45, or variants and derivatives thereof. In an aspect, the Rhizobiaceae virulence gene virL has SEQ ID NO: 46, or variants and fragments thereof. In an aspect, the Rhizobiaceae virulence gene virM has SEQ ID NO: 47, or variants and fragments thereof. In an aspect, the Rhizobiaceae virulence gene virP has SEQ ID NO: 48, or variants and fragments thereof. In an aspect, the Rhizobiaceae virulence gene virQ has SEQ ID NO: 49, or variants and fragments thereof. In an aspect, the Rhizobiaceae virulence genes virD3-D5 and virE1-E3, or variants and fragments thereof, or r-virD3-D5 and r-virE3, or variants and derivatives thereof, wherein the vector comprising the virulence genes r-virD3-D5 and r-virE3 further comprises a r-galls virulence gene having SEQ ID NO: 101, or variants and derivatives thereof. In an aspect, the Rhizobiaceae virulence genes virA, virD3-D5, and virE1-E3, or variants and fragments thereof, or r-virA, r-virD3-D5, and r-virE3, or variants and derivatives thereof, wherein the vector comprising the virulence genes r-virA, r-virD3-D5, and r-virE3 further comprises a r-galls virulence gene having SEQ ID NO: 101, or variants and derivatives thereof. In an aspect, the *Ochrobactrum* further comprises an origin of replication for propagation and stable maintenance in *Escherichia coli*. In an aspect, the origin of replication for propagation and stable maintenance in *Escherichia coli* is derived from a Col E1, pSC101, p15A, or R6K origin of replication, and variants or derivatives thereof. In an aspect, the origin of replication for propagation and stable maintenance in *Escherichia coli* is derived from a Col E1 origin of replication. In an aspect, the origin of replication for propagation and stable maintenance in *Escherichia coli* is derived from the ColE1 origin of replication has SEQ ID NO: 2, or variants and fragments thereof. In an aspect, the origin of replication for propagation and stable maintenance in *Escherichia coli* is derived from a pSC101 origin of replication. In an aspect, the origin of replication for propagation and stable maintenance in *Escherichia coli* is derived from the pSC101 origin of replication has SEQ ID NO: 50, or variants and fragments thereof. In an aspect, the origin of replication for propagation and stable maintenance in *Escherichia coli* is derived from a p15A origin of replication. In an aspect, the origin of replication for propagation and stable maintenance in *Escherichia coli* is derived from the p15A origin of replication has SEQ ID NO: 51, or variants and fragments thereof. In an aspect, the origin of replication for propagation and stable maintenance in *Escherichia coli* is derived from a R6K origin of replication. In an aspect, the origin of replication for propagation and stable maintenance in *Escherichia coli* is derived from the R6K origin of replication has SEQ ID NO: 52, or variants and fragments thereof. In an aspect, the *Ochrobactrum* further comprises an origin of replication for propagation and stable maintenance in *Ochrobactrum* sp. In an aspect, the origin of replication for propagation and stable maintenance in *Ochrobactrum* sp. is a high copy number origin of replication. In an aspect, the origin of replication for propagation and stable maintenance in *Ochrobactrum* sp. is an intermediate copy number origin of replication. In an aspect, the origin of replication for propagation and stable maintenance in *Ochrobactrum* sp. is a low copy number origin of replication. In an aspect, the origin of replication for propagation and stable maintenance in *Ochrobactrum* sp. is derived from a pRi, pVS1, pRFS1010, pRK2, pSa, or pBBR1 origin of replication. In an aspect, the origin of replication for propagation and stable maintenance in *Ochrobactrum* sp. is a variant of the pRK2 origin of replication. In an aspect, the origin of replication for propagation and stable maintenance in *Ochrobactrum* sp. is derived from the pRFS1010 origin of replication. In an aspect, the origin of replication for propagation and stable maintenance in *Ochrobactrum* sp. is derived from the pVS1 origin of replication. In an aspect, the origin of replication for propagation and stable maintenance in *Ochrobactrum* sp. is derived from the pSa origin of replication. In an aspect, the origin of replication for propagation and stable maintenance in *Ochrobactrum* sp. has SEQ ID NO: 3, 37, 38, 53, 57, 58, 59, 60, or 112 or variants and fragments thereof. In an aspect, the origin of replication for propagation and stable maintenance in *Ochrobactrum* sp. is a repABC compatible origin of replication. In an aspect, the repABC compatible origin of replication has SEQ ID NOS: 57, 58, 59, or 60, or variants and fragments thereof. In an aspect, the origin of replication for propagation and stable maintenance in *Escherichia coli* and the origin of replication for propagation and stable maintenance in *Ochrobactrum* sp. are the same origin of replication. In an aspect, the origin of replication is derived from a pRK2 origin of replication, from a pSa origin of replication, or a pRFS1010 origin of replication. In an aspect, the origin of replication is derived from the pRK2 origin of replication. In an aspect, the pRK2 origin of replication has SEQ ID NO: 38, or variants and fragments thereof. In an aspect, the origin of replication is derived from the pSa origin of replication. In an aspect, the pSa origin of replication has SEQ ID NO: 53, or variants and fragments thereof. In an aspect, the origin of replication is derived from the pRFS1010 origin of replication. In an aspect, the pRFS1010 origin of replication has SEQ ID NO: 37, or variants and fragments thereof. In an aspect, the pRK2 origin of replication is a mini or micro pRK2 origin of replication. In an aspect, the pRK2 origin of replication is a micro pRK2 origin of replication. In an aspect, the micro pRK2 origin of replication has SEQ ID NO: 54, or variants and fragments thereof. In an aspect, the pRK2 origin of replication is a mini pRK2 origin of replication. In an aspect, the mini pRK2 has SEQ ID NO: 66, or variants and fragments thereof. In an aspect, the pRK2 origin of replication comprises the trfA and OriV sequences. In an aspect, the pRK2 origin of replication comprises SEQ ID NOS: 64 and 65, or variants and fragments thereof. In an aspect, the *Ochrobactrum* further comprising a sequence derived from the par DE operon. In an aspect, the par DE operon has SEQ ID NO: 55, or variants and fragments thereof. In an aspect, the vector comprises any one of SEQ ID NOS: 34, 35, 36, 106, 113 or 114, or variants and derivatives thereof. In another aspect, the disclosure provides a kit comprising *Ochrobactrum* haywardense H1 comprising a vector in operable linkage comprising: (a) a first nucleic acid comprising a vir gene region, wherein the vir gene region acts to introduce a nucleic acid coding for a sequence of interest into a plant cell in a VirD2-dependent manner; and (b) a second nucleic acid comprising one or more T-DNA border sequence(s) operably linked to a sequence of interest; and (b) instructions for use in transformation of a plant.

In another aspect, the disclosure provides a method of producing a transformed plant cell, the method comprising: (a) contacting a plant cell with an *Ochrobactrum* comprising in operable linkage a first nucleic acid, wherein the first nucleic acid comprises a vir gene region, and a second nucleic acid, wherein the second nucleic acid comprises one or more T-DNA border sequence(s) operably linked to a sequence of interest; (b) culturing the plant cell under conditions allowing *Ochrobactrum* to transfer the sequence of interest to the plant cell; and (c) identifying a transformed plant cell comprising the sequence of interest in its genome. In an aspect, the method further comprising regenerating a plant comprising the sequence of interest in its genome. In an aspect, the plant cell is from a monocot or a dicot. In an aspect, the plant cell is from a plant selected from the group consisting of soybean, tobacco, sunflower, *Arabidopsis*, safflower, alfalfa, corn, wheat, rice, barley, oats, millet, canola, *Brassica*, cotton, and sugarcane. In an aspect, the *Ochrobactrum* is grown in the presence of acetosyringone or other compound that induces vir or r-vir gene function prior to contacting the plant cell. In an aspect, the plant cell is comprised in an explant from a plant seed, seedling, callus, cell suspension, cotyledon, meristem, leaf, root, or stem; and the explant is contacted with the *Ochrobactrum*. In an aspect, the explant comprises an embryonic meristem, a somatic meristem, callus, cell suspension; a cotyledon, a cotyledonary node, or comprises tissue from a leaf, a root, or a stem. In an aspect, identifying a plant cell comprises the sequence of interest is carried out in the absence of a selection agent. In an aspect, identifying a plant cell comprising the sequence of interest comprises culturing the plant cell in the presence of a selection agent, wherein the sequence of interest confers tolerance to the selection agent or is co-delivered with a selectable marker that confers tolerance to the selection agent. In an aspect, the selection agent is chlrosulfuron, ethametsulfuron, imazaphyr, glyphosate, kanamycin, spectinomycin, bialaphos, 2,4-D, or dicamba. In an aspect, the sequence of interest is not physically linked to a selectable marker gene. In an aspect, the marker gene and the sequence of interest genetically segregate in progeny of a plant regenerated from the plant cell comprising the sequence of interest. In an aspect, the *Ochrobactrum* further comprises a third vector in operable linkage comprising a second sequence of interest. In an aspect, regenerating a plant from the plant cell comprises inducing formation of one or more shoots from an explant comprising the plant cell and cultivating at least a first shoot into a whole fertile plant. In an aspect, regeneration occurs by organogenesis. In an aspect, the *Ochrobactrum* is selected from the group consisting of *Ochrobactrum haywardense* H1, *Ochrobactrum cytisi*, *Ochrobactrum daejeonense*, *Ochrobactrum lupine*, *Ochrobactrum oryzae*, *Ochrobactrum tritici*, LBNL124-A-10, HTG3-C-07 and *Ochrobactrum pectoris*. In an aspect, the *Ochrobactrum* further comprises a selectable marker. In an aspect, the selectable marker provides resistance to gentamicin, neomycin/kanamycin, hygromycin, or spectinomycin. In an aspect, the selectable marker gene is an aacC1 gene, a npt1 gene, a npt2 gene, a hpt gene, a SpcN gene, an aph gene or an aadA gene. In an aspect, the selectable marker gene is an aacC1 gene. In an aspect, the aacC1 gene has SEQ ID NO: 1, or variants and fragments thereof. In an aspect, the selectable marker gene is an aadA gene. In an aspect, the aadA gene has SEQ ID NO: 39, or variants and fragments thereof. In an aspect, the selectable marker gene is a npt1 gene. In an aspect, the npt1 gene has SEQ ID NO: 40, or variants and fragments thereof. In an aspect, the selectable marker gene is a npt2 gene. In an aspect, the npt2 gene has SEQ ID NO: 41, or variants and fragments thereof. In an aspect, the selectable marker gene is a hpt gene. In an aspect, the hpt gene has SEQ ID NO: 67, or variants and fragments thereof. In an aspect, the selectable marker gene is not a tetracycline selectable marker gene. In an aspect the selectable marker gene is the SpcN gene having SEQ ID NO: 77, or variants and fragments thereof. In an aspect the selectable marker gene is the aph gene having SEQ ID NO: 78, or variants and fragments thereof. In an aspect, the selectable marker gene is not a tetAR gene. In an aspect, the selectable marker gene is a counter-selectable marker gene. In an aspect, the counter-selectable marker gene is a sacB gene, a rpsL (strA) gene, a pheS gene, a dhfr (folA) gene, a lacY gene, a Gata-1 gene, a ccdB gene, or a thyA– gene. In an aspect, the vir gene region comprises Rhizobiaceae virulence genes virB1-virB11 having SEQ ID NOS: 4-14, respectively, or variants and derivatives thereof or r-virB1-B11 having SEQ ID NOS: 80-90, respectively, or variants and derivatives thereof, wherein the vector comprising the virulence genes r-virB1-B11 further comprises a r-galls virulence gene having SEQ ID NO: 101, or variants and derivatives thereof. In an aspect, the vir gene region comprises Rhizobiaceae virulence genes virC1-C2 having SEQ ID NOS: 16-17, respectively, or variants and derivatives thereof or r-virC1-C2 having SEQ ID NOS: 92-93, respectively, or variants and derivatives thereof, wherein the vector comprising the virulence genes r-virC1-C2 further comprises a r-galls virulence gene having SEQ ID NO: 101, or variants and derivatives thereof. In an aspect, the vir gene region comprises Rhizobiaceae virulence genes virD1-D2 having SEQ ID NOS: 18-19, respectively, or variants and derivatives thereof or r-virD1-D2 having SEQ ID NOS: 94-95, respectively, or variants and derivatives thereof, wherein the vector comprising the virulence genes r-virD1-D2 further comprises a r-galls virulence gene having SEQ ID NO: 101, or variants and derivatives thereof. In an aspect, the vir gene region comprises Rhizobiaceae virulence gene virG having SEQ ID NO: 15, or variants and derivatives thereof or a r-virG virulence gene having SEQ ID NO: 91, or variants and derivatives thereof, wherein the vector comprising the virulence gene r-virG further comprises a r-galls virulence gene having SEQ ID NO: 101, or variants and derivatives thereof. In an aspect, the vir gene region comprises one or more Rhizobiaceae virulence genes virA, virD3, virD4, virD5, virE1, virE2, virE3, virH, virH1, virH2, virK, virL, virM, virP, virQ, r-virA, r-virD3, r-virD4, r-virD5, r-virE3, or r-virF or variants and derivatives thereof, wherein the vector comprising the virulence genes r-virA, r-virD3, r-virD4, r-virD5, r-virE3, or r-virF further comprises a r-galls virulence gene having SEQ ID NO: 101, or variants and derivatives thereof. In an aspect, the Rhizobiaceae virulence gene is virA having SEQ ID NO: 26, or variants and derivatives, or a r-virA virulence gene having SEQ ID NO: 79, or variants and derivatives thereof, wherein the vector comprising the virulence gene r-virA further comprises a r-galls virulence gene having SEQ ID NO: 101, or variants and derivatives thereof. In an aspect, the Rhizobiaceae virulence genes virD3-D5 have, respectively, SEQ ID NOS: 20-22, or variants and derivatives thereof or the r-virD3-D5 virulence genes having SEQ ID NO: 96-98, respectively, or variants and derivatives thereof, wherein the vector comprising the virulence gene r-virD3-D5 further comprises a r-galls virulence gene having SEQ ID NO: 101, or variants and derivatives thereof. In an aspect, the Rhizobiaceae virulence genes virE1-E3 have, respectively, SEQ ID NOS: 23-25, or variants and derivatives thereof or a r-virE3 virulence gene having SEQ ID NO: 100, or variants and derivatives thereof, wherein the vector comprising the virulence gene r-virE3 further comprises a r-galls virulence gene having SEQ ID NO: 101, or variants and derivatives thereof. In an aspect, the Rhizobiaceae virulence genes virH-H2 have, respectively, SEQ ID NOS: 42-43, or variants and derivatives thereof. In an aspect, the Rhizobiaceae virulence gene virK has SEQ ID NO: 45, or variants and derivatives thereof. In an aspect, the Rhizobiaceae virulence gene virL has SEQ ID NO: 46, or variants and fragments thereof. In an aspect, the Rhizobiaceae virulence gene virM has SEQ ID NO: 47, or variants and fragments thereof. In an aspect, the Rhizobiaceae virulence gene virP has SEQ ID NO: 48, or variants and fragments thereof. In an aspect, the Rhizobiaceae virulence gene virQ has SEQ ID NO: 49, or variants and fragments thereof. In an aspect, the method comprises the Rhizobiaceae virulence genes virD3-D5 and virE1-E3, or variants and fragments thereof, or r-virD3-D5 and r-virE3, or variants and derivatives thereof, wherein the vector comprising the virulence genes r-virD3-D5 and r-virE3 further comprises a r-galls virulence gene having SEQ ID NO: 101, or variants and derivatives thereof. In an aspect, the method comprises the Rhizobiaceae virulence genes virA, virD3-D5, and virE1-E3, or variants and fragments thereof, or r-virA, r-virD3-D5, and r-virE3, or variants and derivatives thereof, wherein the vector comprising the virulence genes r-virA, r-virD3-D5, and r-virE3 further comprises a r-galls virulence gene having SEQ ID NO: 101, or variants and derivatives thereof. In an aspect, the *Ochrobactrum* further comprises an origin of replication for propagation and stable maintenance in *Escherichia coli*. In an aspect, the origin of replication for propagation and stable maintenance in *Escherichia coli* is derived from a Col E1, pSC101, p15A, or R6K origin of replication, and variants or derivatives thereof. In an aspect, the origin of replication for propagation and stable maintenance in *Escherichia coli* is derived from a Col E1 origin of replication. In an aspect, the origin of replication for propagation and stable maintenance in *Escherichia coli* is derived from the ColE1 origin of replication has SEQ ID NO: 2, or variants and fragments thereof. In an aspect, the origin of replication for propagation and stable maintenance in *Escherichia coli* is derived from a pSC101 origin of replication. In an aspect, the origin of replication for propagation and stable maintenance in *Escherichia coli* is derived from the pSC101 origin of replication has SEQ ID NO: 50, or variants and fragments thereof. In an aspect, the origin of replication for propagation and stable maintenance in *Escherichia coli* is derived from a p15A origin of replication. In an aspect, the origin of replication for propagation and stable maintenance in *Escherichia coli* is derived from the p15A origin of replication has SEQ ID NO: 51, or variants and fragments thereof. In an aspect, the origin of replication for propagation and stable maintenance in *Escherichia coli* is derived from a R6K origin of replication. In an aspect, the origin of replication for propagation and stable maintenance in *Escherichia coli* is derived from the R6K origin of replication has SEQ ID NO: 52, or variants and fragments thereof. In an aspect, the *Ochrobactrum* further comprises an origin of replication for propagation and stable maintenance in *Ochrobactrum* sp. In an aspect, the origin of replication for propagation and stable maintenance in *Ochrobactrum* sp. is a high copy number origin of replication. In an aspect, the origin of replication for propagation and stable maintenance in *Ochrobactrum* sp. is an intermediate copy number origin of replication. In an aspect, the origin of replication for propagation and stable maintenance in *Ochrobactrum* sp. is a low copy number origin of replication. In an aspect, the origin of replication for propagation and stable maintenance in *Ochrobactrum* sp. is derived from a pRi, pVS1, pRFS1010, pRK2, pSa, or pBBR1 origin of replication. In an aspect, the origin of replication for propagation and stable maintenance in *Ochrobactrum* sp. is a variant of the pRK2 origin of replication. In an aspect, the origin of replication for propagation and stable maintenance in *Ochrobactrum* sp. is derived from the pRFS1010 origin of replication. In an aspect, the origin of replication for propagation and stable maintenance in *Ochrobactrum* sp. is derived from the pVS1 origin of replication. In an aspect, the origin of replication for propagation and stable maintenance in *Ochrobactrum* sp. is derived from the pSa origin of replication. In an aspect, the origin of replication for propagation and stable maintenance in *Ochrobactrum* sp. has SEQ ID NO: 3, 37, 38, 53, 57, 58, 59, 60, or 112 or variants and fragments thereof. In an aspect, the origin of replication for propagation and stable maintenance in *Ochrobactrum* sp. is a repABC compatible origin of replication. In an aspect, the repABC compatible origin of replication has SEQ ID NOS: 57, 58, 59, or 60, or variants and fragments thereof. In an aspect, the origin of replication for propagation and stable maintenance in *Escherichia coli* and the origin of replication for propagation and stable maintenance in *Ochrobactrum* sp. are the same origin of replication. In an aspect, the origin of replication is derived from a pRK2 origin of replication, from a pSa origin of replication, or a pRFS1010 origin of replication. In an aspect, the origin of replication is derived from the pRK2 origin of replication. In an aspect, the pRK2 origin of replication has SEQ ID NO: 38, or variants and fragments thereof. In an aspect, the origin of replication is derived from the pSa origin of replication. In an aspect, the pSa origin of replication has SEQ ID NO: 53, or variants and fragments thereof. In an aspect, the origin of replication is derived from the pRFS1010 origin of replication. In an aspect, the pRFS1010 origin of replication has SEQ ID NO: 37, or variants and fragments thereof. In an aspect, the pRK2 origin of replication is a mini or micro pRK2 origin of replication. In an aspect, the pRK2 origin of replication is a micro pRK2 origin of replication. In an aspect, the micro pRK2 origin of replication has SEQ ID NO: 54, or variants and fragments thereof. In an aspect, the pRK2 origin of replication is a mini pRK2 origin of replication. In an aspect, the mini pRK2 has SEQ ID NO: 66, or variants and fragments thereof. In an aspect, the pRK2 origin of replication comprises the trfA and OriV sequences. In an aspect, the pRK2 origin of replication comprises SEQ ID NOS: 64 and 65, or variants and fragments thereof. In an aspect, the method further comprising a sequence derived from the par DE operon. In an aspect, the par DE operon has SEQ ID NO: 55, or variants and fragments thereof. In an aspect, the vector comprises any one of SEQ ID NO: 34, 35, 36, 106, 113 or 114, or variants and derivatives thereof.

In another aspect, the disclosure provides an *Ochrobactrum haywardense* H1, comprising: a first vector comprising in operable linkage: (a) an origin of replication for propagation and stable maintenance in *Escherichia coli*; (b) an origin of replication for propagation and stable maintenance in *Ochrobactrum* sp. (c) a selectable marker gene; and (d) Rhizobiaceae virulence genes virB1-B11 or r-virB1-B11, virC1-C2 or r-virC1-C2, virD1-D2 or r-virD1-D2, and virG or r-virG, or variants and derivatives thereof, wherein the vector comprising the virulence genes r-virB1-B11, r-virC1-C2, r-virD1-D2, and r-virG further comprises a r-galls virulence gene, having SEQ ID NO: 101, or variants and derivatives thereof thereof; and a second vector comprising in operable linkage one or more T-DNA border sequence(s) operably linked to a sequence of interest. In an aspect, the Rhizobiaceae virulence genes are virB1-virB11 having SEQ ID NOS: 4-14, respectively, or variants and derivatives thereof or r-virB1-B11 having SEQ ID NOS: 80-90, respectively, or variants and derivatives thereof. In an aspect, the Rhizobiaceae virulence genes are virC1-C2 having SEQ ID NOS: 16-17, respectively, or variants and derivatives thereof or r-virC1-C2 having SEQ ID NOS: 92-93, respectively, or variants and derivatives thereof. In an aspect, the Rhizobiaceae virulence genes are virD1-D2 having SEQ ID NOS: 18-19, respectively, or variants and derivatives thereof or r-virD1-D2 having SEQ ID NOS: 94-95, respectively, or variants and derivatives thereof. In an aspect, the Rhizobiaceae virulence gene is virG having SEQ ID NO: 15, or variants and derivatives thereof or a r-virG virulence gene having SEQ ID NO: 91, or variants and derivatives thereof. In an aspect, the *Ochrobactrum* further comprising one or more of Rhizobiaceae virulence genes virA, virD3, virD4, virD5, virE1, virE2, virE3, virH, virH1, virH2, virK, virL, virM, virP, virQ, r-virA, r-virD3, r-virD4, r-virD5, r-virE3, or r-virF or variants and derivatives thereof. In an aspect, the origin of replication for propagation and stable maintenance in *Escherichia coli* is derived from a Col E1, pSC101, p15A, or R6K origin of replication, or variants or derivatives thereof. In an aspect, the origin of replication for propagation and stable maintenance in *Escherichia coli* is derived from a Col E1 origin of replication. In an aspect, the origin of replication for propagation and stable maintenance in *Escherichia coli* is derived from the ColE1 origin of replication has SEQ ID NO: 2, or variants and fragments thereof. In an aspect, the origin of replication for propagation and stable maintenance in *Escherichia coli* is derived from a pSC101 origin of replication. In an aspect, the origin of replication for propagation and stable maintenance in *Escherichia coli* is derived from the pSC101 origin of replication has SEQ ID NO: 50, or variants and fragments thereof. In an aspect, the origin of replication for propagation and stable maintenance in *Escherichia coli* is derived from a p15A origin of replication. In an aspect, the origin of replication for propagation and stable maintenance in *Escherichia coli* is derived from the p15A origin of replication has SEQ ID NO: 51, or variants and fragments thereof. In an aspect, the origin of replication for propagation and stable maintenance in *Escherichia coli* is derived from a R6K origin of replication. In an aspect, the origin of replication for propagation and stable maintenance in *Escherichia coli* is derived from the R6K origin of replication has SEQ ID NO: 52, or variants and fragments thereof. In an aspect, the origin of replication for propagation and stable maintenance in *Ochrobactrum* sp. is a high copy number origin of replication. In an aspect, the origin of replication for propagation and stable maintenance in *Ochrobactrum* sp. is an intermediate copy number origin of replication. In an aspect, the origin of replication for propagation and stable maintenance in *Ochrobactrum* sp. is a low copy number origin of replication. In an aspect, the origin of replication for propagation and stable maintenance in *Ochrobactrum* sp. is derived from a pRi, pVS1, pRFS1010, pRK2, pSa, or pBBR1 origin of replication. In an aspect, the origin of replication for propagation and stable maintenance in *Ochrobactrum* sp. is a variant of the pRK2 origin of replication. In an aspect, the origin of replication for propagation and stable maintenance in *Ochrobactrum* sp. is derived from the pRFS1010 origin of replication. In an aspect, the origin of replication for propagation and stable maintenance in *Ochrobactrum* sp. is derived from the pVS1 origin of replication. In an aspect, the origin of replication for propagation and stable maintenance in *Ochrobactrum* sp. is derived from the pSa origin of replication. In an aspect, the origin of replication for propagation and stable maintenance in *Ochrobactrum* sp. has SEQ ID NO: 3, 37, 38, 53, 57, 58, 59, 60, or 112, or variants and fragments thereof. In an aspect, the origin of replication for propagation and stable maintenance in *Ochrobactrum* sp. is a repABC compatible origin of replication. In an aspect, the repABC compatible origin of replication has SEQ ID NOS: 57, 58, 59, or 60, or variants and fragments thereof. In an aspect, the origin of replication for propagation and stable maintenance in *Escherichia coli* and the origin of replication for propagation and stable maintenance in *Ochrobactrum* sp. are the same origin of replication. In an aspect, the origin of replication is derived from a pRK2 origin of replication, from a pSa origin of replication, or a pRFS1010 origin of replication. In an aspect, the origin of replication is derived from the pRK2 origin of replication. In an aspect, the pRK2 origin of replication has SEQ ID NO: 38, or variants and fragments thereof. In an aspect, the origin of replication is derived from the pSa origin of replication. In an aspect, the pSa origin of replication has SEQ ID NO: 53, or variants and fragments thereof. In an aspect, the origin of replication is derived from the pRFS1010 origin of replication. In an aspect, the pRFS1010 origin of replication has SEQ ID NO: 37, or variants and fragments thereof. In an aspect, the origin of replication is derived from the pRK2 origin of replication. In an aspect, the pRK2 origin of replication is a mini or micro pRK2 origin of replication. In an aspect, the pRK2 origin of replication is a micro pRK2 origin of replication. In an aspect, the micro pRK2 origin of replication has SEQ ID NO: 54, or variants and fragments thereof. In an aspect, the pRK2 origin of replication is a mini pRK2 origin of replication. In an aspect, the mini pRK2 has SEQ ID NO: 66, or variants and fragments thereof. In an aspect, the pRK2 origin of replication comprises the trfA and OriV sequences. In an aspect, the pRK2 origin of replication comprises SEQ ID NOS: 64 and 65, or variants and fragments thereof. In an aspect, the *Ochrobactrum* further comprising a sequence derived from the par DE operon. In an aspect, the par DE operon has SEQ ID NO: 55, or variants and fragments thereof. In an aspect, the selectable marker provides resistance to gentamicin, neomycin/kanamycin, hygromycin, or spectinomycin. In an aspect, the selectable marker gene is an aacC1 gene, a npt1 gene, a npt2 gene, a hpt gene, a SpcN gene, an aph gene or an aadA gene. In an aspect, the selectable marker gene is an aacC1 gene. In an aspect, the aacC1 gene has SEQ ID NO: 1, or variants and fragments thereof. In an aspect, the selectable marker gene is an aadA gene. In an aspect, the aadA gene has SEQ ID NO: 39, or variants and fragments thereof. In an aspect, the selectable marker gene is a npt1 gene. In an aspect, the npt1 gene has SEQ ID NO: 40, or variants and fragments thereof. In an aspect, the selectable marker gene is a npt2 gene. In an aspect, the npt2 gene has SEQ ID NO: 41, or variants and fragments thereof. In an aspect, the selectable marker gene is a hpt gene. In an aspect, the hpt gene has SEQ ID NO: 67, or variants and fragments thereof. In an aspect the selectable marker gene is the SpcN gene having SEQ ID NO: 77, or variants and fragments thereof. In an aspect the selectable marker gene is the aph gene having SEQ ID NO: 78, or variants and fragments thereof. In an aspect, the selectable marker gene is not a tetracycline selectable marker gene. In an aspect, the selectable marker gene is not a tetAR gene. In an aspect, the selectable marker gene is a counter-selectable marker gene. In an aspect, the counter-selectable marker gene is a sacB gene, a rpsL (strA) gene, a pheS gene, a dhfr (folA) gene, a lacY gene, a Gata-1 gene, a ccdB gene, or a thyA− gene. In an aspect, the first vector does not comprise SEQ ID NO: 61, or variants or fragments thereof. In an aspect, the first vector does not comprise SEQ ID NO: 62, or variants or fragments thereof. In an aspect, the first vector does not comprise a tra operon sequence or a trb operon sequence, or variants or fragments thereof. In an aspect, the first vector does not comprise SEQ ID NO: 63, or variants or fragments thereof. In an aspect, the first vector has SEQ ID NO: 34, or variants and fragments thereof. In an aspect, the first vector has SEQ ID NO: 35, or variants and fragments thereof. In an aspect, the first vector SEQ ID NO: 36, or variants and fragments thereof. In an aspect, the vector comprises any one of SEQ ID NO: 34, 35, 36, 106, 113 or 114, or variants and derivatives thereof. In another aspect, the method provides a kit comprising: (a) the Ochrobacterum comprising: a first vector comprising in operable linkage: (a) an origin of replication for propagation and stable maintenance in *Escherichia coli*; (b) an origin of replication for propagation and stable maintenance in *Ochrobactrum* sp. (c) a selectable marker gene; and (d) Rhizobiaceae virulence genes virB1-B11 or r-virB1-B11, virC1-C2 or r-virC1-C2, virD1-D2 or r-virD1-D2, and virG or r-virG, or variants and derivatives thereof, wherein the vector comprising the virulence genes r-virB1-B11, r-virC1-C2, r-virD1-D2, and r-virG further comprises a r-galls virulence gene, having SEQ ID NO: 101, or variants and derivatives thereof thereof; and a second vector comprising in operable linkage one or more T-DNA border sequence(s) operably linked to a sequence of interest; and (b) instructions for use in transformation of a plant.

In another aspect, the disclosure provides an *Ochrobactrum haywardense* H1, comprising: a first vector comprising in operable linkage: (a) an origin of replication for propagation in *Escherichia coli* having SEQ ID NO: 2, or variants and fragments thereof; (b) an origin of replication for propagation in *Ochrobactrum* sp. having SEQ ID NO: 3, or variants and fragments thereof; (c) a selectable marker gene having SEQ ID NO: 1, or variants and fragments thereof; and (d) virulence genes comprising *Agrobacterium* spp. virulence genes virB1-B11 virulence genes having SEQ ID NOS: 4-14, respectively or r-virB1-B11 virulence genes having SEQ ID NOS: 80-90, respectively, virC1-C2 virulence genes having SEQ ID NOS: 16-17, respectively or r-virC1-C2 virulence genes having SEQ ID NOS: 92-93, respectively, virD1-D2 virulence genes having SEQ ID NOS: 18-19, respectively or r-virD1-D2 virulence genes having SEQ ID NOS: 94-95, respectively, and a virG virulence gene having SEQ ID NO: 15 or a r-virG virulence gene having SEQ ID NO: 91, or variants and derivatives thereof, wherein the vector comprising the virulence genes r-virB1-B11, r-virC1-C2, r-virD1-D2, and r-virG further comprises a r-galls virulence gene having SEQ ID NO: 101, or variants and derivatives thereof; and a second vector comprising in operable linkage one or more T-DNA border sequence(s) operably linked to a sequence of interest. In an aspect, the vector comprises any one of SEQ ID NO: 34, 35, 36, 106, 113 or 114, or variants and derivatives thereof. In another aspect, the disclosure provides a kit comprising: (a) the *Ochrobactrum* comprising a first vector comprising in operable linkage: (a) an origin of replication for propagation in *Escherichia coli* having SEQ ID NO: 2, or variants and fragments thereof; (b) an origin of replication for propagation in *Ochrobactrum* sp. having SEQ ID NO: 3, or variants and fragments thereof; (c) a selectable marker gene having SEQ ID NO: 1, or variants and fragments thereof; and (d) virulence genes comprising *Agrobacterium* spp. virulence genes virB1-B11 virulence genes having SEQ ID NOS: 4-14, respectively or r-virB1-B11 virulence genes having SEQ ID NOS: 80-90, respectively, virC1-C2 virulence genes having SEQ ID NOS: 16-17, respectively or r-virC1-C2 virulence genes having SEQ ID NOS: 92-93, respectively, virD1-D2 virulence genes having SEQ ID NOS: 18-19, respectively or r-virD1-D2 virulence genes having SEQ ID NOS: 94-95, respectively, and a virG virulence gene having SEQ ID NO: 15 or a r-virG virulence gene having SEQ ID NO: 91, or variants and derivatives thereof, wherein the vector comprising the virulence genes r-virB1-B11, r-virC1-C2, r-virD1-D2, and r-virG further comprises a r-galls virulence gene having SEQ ID NO: 101, or variants and derivatives thereof; and a second vector comprising in operable linkage one or more T-DNA border sequence(s) operably linked to a sequence of interest; and (b) instructions for use in transformation of a plant.

In another aspect, the disclosure provides an *Ochrobactrum haywardense* H1, comprising: a first vector comprising in operable linkage: (a) an origin of replication for propagation in *Escherichia coli* having SEQ ID NO: 2, or variants and fragments thereof; (b) an origin of replication for propagation in *Ochrobactrum* sp. having SEQ ID NO: 3, or variants and fragments thereof; (c) a selectable marker gene having SEQ ID NO: 1, or variants and fragments thereof; and (d) sequences comprising the *Agrobacterium* spp. virulence genes virB1-B11 virulence genes having SEQ ID NOS: 4-14, respectively or r-virB1-B11 virulence genes having SEQ ID NOS: 80-90, respectively, virC1-C2 virulence genes having SEQ ID NOS: 16-17, respectively or r-virC1-C2 virulence genes having SEQ ID NOS: 92-93, respectively, virD1-D5 virulence genes having SEQ ID NOS: 18-22, respectively or r-virD1-D5 virulence genes having SEQ ID NOS: 94-98, respectively, virE1-E3 virulence genes having SEQ ID NOS: 23-25, respectively or a r-virE3 virulence gene having SEQ ID NO: 100, and a virG virulence gene having SEQ ID NO: 15 or a r-virG virulence gene having SEQ ID NO: 91, or variants and derivatives thereof, wherein the vector comprising the virulence genes r-virB1-B11, r-virC1-C2, r-virD1-D5, r-virE3, and r-virG further comprises a r-galls virulence gene having SEQ ID NO: 101, or variants and derivatives thereof, and a second vector comprising in operable linkage one or more T-DNA border sequence(s) operably linked to a sequence of interest. In an aspect, the vector comprises any one of SEQ ID NO: 34, 35, 36, 106, 113 or 114, or variants and derivatives thereof. In another aspect, the disclosure provides kit comprising: (a) the *Ochrobactrum* comprising: a first vector comprising in operable linkage: (a) an origin of replication for propagation in *Escherichia coli* having SEQ ID NO: 2, or variants and fragments thereof; (b) an origin of replication for propagation in *Ochrobactrum* sp. having SEQ ID NO: 3, or variants and fragments thereof; (c) a selectable marker gene having SEQ ID NO: 1, or variants and fragments thereof; and (d) sequences comprising the *Agrobacterium* spp. virulence genes virB1-B11 virulence genes having SEQ ID NOS: 4-14, respectively or r-virB1-B11 virulence genes having SEQ ID NOS: 80-90, respectively, virC1-C2 virulence genes having SEQ ID NOS: 16-17, respectively or r-virC1-C2 virulence genes having SEQ ID NOS: 92-93, respectively, virD1-D5 virulence genes having SEQ ID NOS: 18-22, respectively or r-virD1-D5 virulence genes having SEQ ID NOS: 94-98, respectively, virE1-E3 virulence genes having SEQ ID NOS: 23-25, respectively or a r-virE3 virulence gene having SEQ ID NO: 100, and a virG virulence gene having SEQ ID NO: 15 or a r-virG virulence gene having SEQ ID NO: 91, or variants and derivatives thereof, wherein the vector comprising the virulence genes r-virB1-B11, r-virC1-C2, r-virD1-D5, r-virE3, and r-virG further comprises a r-galls virulence gene having SEQ ID NO: 101, or variants and derivatives thereof, and a second vector comprising in operable linkage one or more T-DNA border sequence(s) operably linked to a sequence of interest; and (b) instructions for use in transformation of a plant.

In another aspect, the disclosure provides an *Ochrobactrum haywardense* H1, comprising: a first vector comprising in operable linkage: (a) an origin of replication for propagation in *Escherichia coli* having SEQ ID NO: 2, or variants and fragments thereof; (b) an origin of replication for propagation in *Ochrobactrum* sp. having SEQ ID NO: 3, or variants and fragments thereof; (c) a selectable marker gene having SEQ ID NO: 1; and (d) sequences comprising the *Agrobacterium* spp. virulence genes a virA virulence gene having SEQ ID NO: 26 or a r-virA virulence gene having SEQ ID NO: 79, virB1-B11 virulence genes having SEQ ID NOS: 4-14, respectively or r-virB1-B11 virulence genes having SEQ ID NOS: 80-90, respectively, virC1-C2 virulence genes having SEQ ID NOS: 16-17, respectively or r-virC1-C2 virulence genes having SEQ ID NOS: 92-93, respectively, virD1-D5 virulence genes having SEQ ID NOS: 18-22, respectively or r-virD1-D5 virulence genes having SEQ ID NOS: 94-98, respectively, virE1-E3 virulence genes having SEQ ID NOS: 23-25, respectively or a r-virE3 virulence gene having SEQ ID NOS: 100, a virG virulence gene having SEQ ID NO: 15 or a r-virG virulence gene having SEQ ID NO: 91, and a virJ virulence gene having SEQ ID NO: 27, or variants and derivatives thereof, wherein the vector comprising the virulence genes r-virA, r-virB1-B11, r-virC1-C2, r-virD1-D5, r-virE3, and r-virG further comprises a r-galls virulence gene having SEQ ID NO: 101, or variants and derivatives thereof, and a second vector comprising in operable linkage one or more T-DNA border sequence(s) operably linked to a sequence of interest. In an aspect, the vector comprises any one of SEQ ID NO: 34, 35, 36, 106, 113 or 114, or variants and derivatives thereof. In another aspect, the disclosure provides a kit comprising: (a) the *Ochrobactrum* comprising: a first vector comprising in operable linkage: (a) an origin of replication for propagation in *Escherichia coli* having SEQ ID NO: 2, or variants and fragments thereof; (b) an origin of replication for propagation in *Ochrobactrum* sp. having SEQ ID NO: 3, or variants and fragments thereof; (c) a selectable marker gene having SEQ ID NO: 1; and (d) sequences comprising the *Agrobacterium* spp. virulence genes a virA virulence gene having SEQ ID NO: 26 or a r-virA virulence gene having SEQ ID NO: 79, virB1-B11 virulence genes having SEQ ID NOS: 4-14, respectively or r-virB1-B11 virulence genes having SEQ ID NOS: 80-90, respectively, virC1-C2 virulence genes having SEQ ID NOS: 16-17, respectively or r-virC1-C2 virulence genes having SEQ ID NOS: 92-93, respectively, virD1-D5 virulence genes having SEQ ID NOS: 18-22, respectively or r-virD1-D5 virulence genes having SEQ ID NOS: 94-98, respectively, virE1-E3 virulence genes having SEQ ID NOS: 23-25, respectively or a r-virE3 virulence gene having SEQ ID NOS: 100, a virG virulence gene having SEQ ID NO: 15 or a r-virG virulence gene having SEQ ID NO: 91, and a virJ virulence gene having SEQ ID NO: 27, or variants and derivatives thereof, wherein the vector comprising the virulence genes r-virA, r-virB1-B11, r-virC1-C2, r-virD1-D5, r-virE3, and r-virG further comprises a r-galls virulence gene having SEQ ID NO: 101, or variants and derivatives thereof, and a second vector comprising in operable linkage one or more T-DNA border sequence(s) operably linked to a sequence of interest; and (b) instructions for use in transformation of a plant.

In another aspect, the disclosure provides a method of producing a transformed plant cell, the method comprising: contacting a plant cell with an *Ochrobactrum* comprising in a first vector in operable linkage: (a) an origin of replication for propagation and stable maintenance in *Escherichia coli*; (b) an origin of replication for propagation and stable maintenance in *Ochrobactrum* sp. (c) a selectable marker gene; and (d) Rhizobiaceae virulence genes virB1-B11 virulence genes having SEQ ID NOS: 4-14, respectively or r-virB1-B11 virulence genes having SEQ ID NOS: 80-90, respectively, virC1-C2 virulence genes having SEQ ID NOS: 16-17, respectively or r-virC1-C2 virulence genes having SEQ ID NOS: 92-93, respectively, virD1-D2 virulence genes having SEQ ID NOS: 18-19, respectively or r-virD1-D2 virulence genes having SEQ ID NOS: 94-95, respectively, and a virG virulence gene having SEQ ID NO: 15 or a r-virG virulence gene having SEQ ID NO: 91, or variants and derivatives thereof, wherein the vector comprising the virulence genes r-virB1-B11, r-virC1-C2, r-virD1-D2, and r-virG further comprises a r-galls virulence gene having SEQ ID NO: 101, or variants and derivatives thereof; and a second vector comprising in operable linkage one or more T-DNA border sequence(s) operably linked to a sequence of interest; culturing the plant cell under conditions allowing *Ochrobactrum* to transfer the sequence of interest to the plant cell; and identifying a transformed plant cell comprising the sequence of interest in its genome. In an aspect, the Rhizobiaceae virulence genes virB1-virB11 have SEQ ID NOS: 4-14, respectively, or variants and derivatives thereof or r-virB1-B11 have SEQ ID NOS: 80-90, respectively, or variants and derivatives thereof. In an aspect, the Rhizobiaceae virulence virC1-C2 have SEQ ID NOS: 16-17, respectively, or variants and derivatives thereof or r-virC1-C2 have SEQ ID NOS: 92-93, respectively, or variants and derivatives thereof. In an aspect, the Rhizobiaceae virulence genes virD1-D2 have SEQ ID NOS: 18-19, respectively, or variants and derivatives thereof or r-virD1-D2 having SEQ ID NOS: 94-95, respectively, or variants and derivatives thereof. In an aspect, the Rhizobiaceae virulence gene virG have SEQ ID NO: 15, or variants and derivatives thereof or a r-virG virulence gene having SEQ ID NO: 91, or variants and derivatives thereof. In an aspect, the method further comprising one or more of Rhizobiaceae virulence genes virA, virD3, virD4, virD5, virE1, virE2, virE3, virH, virH1, virH2, virK, virL, virM, virP, virQ, r-virA, r-virD3, r-virD4, r-virD5, r-virE3, or r-virF or variants and derivatives thereof. In an aspect, the origin of replication for propagation and stable maintenance in *Escherichia coli* is derived from a Col E1, pSC101, p15A, or R6K origin of replication, or variants or derivatives thereof. In an aspect, the origin of replication for propagation and stable maintenance in *Escherichia coli* is derived from a Col E1 origin of replication. In an aspect, the origin of replication for propagation and stable maintenance in *Escherichia coli* is derived from the ColE1 origin of replication has SEQ ID NO: 2, or variants and fragments thereof. In an aspect, the origin of replication for propagation and stable maintenance in *Escherichia coli* is derived from a pSC101 origin of replication. In an aspect, the origin of replication for propagation and stable maintenance in *Escherichia coli* is derived from the pSC101 origin of replication has SEQ ID NO: 50, or variants and fragments thereof. In an aspect, the origin of replication for propagation and stable maintenance in *Escherichia coli* is derived from a p15A origin of replication. In an aspect, the origin of replication for propagation and stable maintenance in *Escherichia coli* is derived from the p15A origin of replication has SEQ ID NO: 51, or variants and fragments thereof. In an aspect, the origin of replication for propagation and stable maintenance in *Escherichia coli* is derived from a R6K origin of replication. In an aspect, the origin of replication for propagation and stable maintenance in *Escherichia coli* is derived from the R6K origin of replication has SEQ ID NO: 52, or variants and fragments thereof. In an aspect, the origin of replication for propagation and stable maintenance in *Ochrobactrum* sp. is a high copy number origin of replication. In an aspect, the origin of replication for propagation and stable maintenance in *Ochrobactrum* sp. is an intermediate copy number origin of replication. In an aspect, the origin of replication for propagation and stable maintenance in *Ochrobactrum* sp. is a low copy number origin of replication. In an aspect, the origin of replication for propagation and stable maintenance in *Ochrobactrum* sp. is derived from a pRi, pVS1, pRFS1010, pRK2, pSa, or pBBR1 origin of replication. In an aspect, the origin of replication for propagation and stable maintenance in *Ochrobactrum* sp. is a variant of the pRK2 origin of replication. In an aspect, the origin of replication for propagation and stable maintenance in *Ochrobactrum* sp. is derived from the pRFS1010 origin of replication. In an aspect, the origin of replication for propagation and stable maintenance in *Ochrobactrum* sp. is derived from the pVS1 origin of replication. In an aspect, the origin of replication for propagation and stable maintenance in *Ochrobactrum* sp. is derived from the pSa origin of replication. In an aspect, the origin of replication for propagation and stable maintenance in *Ochrobactrum* sp. has SEQ ID NO: 3, 37, 38, 53, 57, 58, 59, 60, or 112 or variants and fragments thereof. In an aspect, the origin of replication for propagation and stable maintenance in *Ochrobactrum* sp. is a repABC compatible origin of replication. In an aspect, the repABC compatible origin of replication has SEQ ID NOS: 57, 58, 59, or 60, or variants and fragments thereof. In an aspect, the origin of replication for propagation and stable maintenance in *Escherichia coli* and the origin of replication for propagation and stable maintenance in *Ochrobactrum* sp. are the same origin of replication. In an aspect, the origin of replication is derived from a pRK2 origin of replication, from a pSa origin of replication, or a pRFS1010 origin of replication. In an aspect, the origin of replication is derived from the pRK2 origin of replication. In an aspect, the pRK2 origin of replication has SEQ ID NO: 38, or variants and fragments thereof. In an aspect, the origin of replication is derived from the pSa origin of replication. In an aspect, the pSa origin of replication has SEQ ID NO: 53, or variants and fragments thereof. In an aspect, the origin of replication is derived from the pRFS1010 origin of replication. In an aspect, the pRFS1010 origin of replication has SEQ ID NO: 37, or variants and fragments thereof. In an aspect, the origin of replication is derived from the pRK2 origin of replication. In an aspect, the pRK2 origin of replication is a mini or micro pRK2 origin of replication. In an aspect, the pRK2 origin of replication is a micro pRK2 origin of replication. In an aspect, the micro pRK2 origin of replication has SEQ ID NO: 54, or variants and fragments thereof. In an aspect, the pRK2 origin of replication is a mini pRK2 origin of replication. In an aspect, the mini pRK2 has SEQ ID NO: 66, or variants and fragments thereof. In an aspect, In an aspect, the pRK2 origin of replication comprises the trfA and OriV sequences. In an aspect, the pRK2 origin of replication comprises SEQ ID NOS: 64 and 65, or variants and fragments thereof. In an aspect, the method further comprising a sequence derived from the par DE operon. In an aspect, the par DE operon has SEQ ID NO: 55, or variants and fragments thereof. In an aspect, the selectable marker provides resistance to gentamicin, neomycin/kanamycin, hygromycin, or spectinomycin. In an aspect, the selectable marker gene is an aacC1 gene, a npt1 gene, a npt2 gene, a hpt gene, a SpcN gene, an aph gene or an aadA gene. In an aspect, the selectable marker gene is an aacC1 gene. In an aspect, the aacC1 gene has SEQ ID NO: 1, or variants and fragments thereof. In an aspect, the selectable marker gene is an aadA gene. In an aspect, the aadA gene has SEQ ID NO: 39, or variants and fragments thereof. In an aspect, the selectable marker gene is a npt1 gene. In an aspect, the npt1 gene has SEQ ID NO: 40, or variants and fragments thereof. In an aspect, the selectable marker gene is a npt2 gene. In an aspect, the npt2 gene has SEQ ID NO: 41, or variants and fragments thereof. In an aspect, the selectable marker gene is a hpt gene. In an aspect, the hpt gene has SEQ ID NO: 67, or variants and fragments thereof. In an aspect the selectable marker gene is the SpcN gene having SEQ ID NO: 77, or variants and fragments thereof. In an aspect the selectable marker gene is the aph gene having SEQ ID NO: 78, or variants and fragments thereof. In an aspect, the selectable marker gene is not a tetracycline selectable marker gene. In an aspect, the selectable marker gene is not a tetAR gene. In an aspect, the selectable marker gene is a counter-selectable marker gene. In an aspect, the counter-selectable marker gene is a sacB gene, a rpsL (strA) gene, a pheS gene, a dhfr (folA) gene, a lacY gene, a Gata-1 gene, a ccdB gene, or a thyA- gene. In an aspect, the first vector does not comprise SEQ ID NO: 61, or variants or fragments thereof. In an aspect, the first vector does not comprise SEQ ID NO: 62, or variants or fragments thereof. In an aspect, the first vector does not comprise a tra operon sequence or a trb operon sequence, or variants or fragments thereof. In an aspect, the first vector does not comprise SEQ ID NO: 63, or variants or fragments thereof. In an aspect, the first vector has SEQ ID NO: 34, or variants and fragments thereof. In an aspect, the first vector has SEQ ID NO: 35, or variants and fragments thereof. In an aspect, the first vector has SEQ ID NO: 36, or variants and fragments thereof. In an aspect, the method further comprising regenerating a plant comprising the sequence of interest in its genome. In an aspect, the plant cell is from a monocot or a dicot. In an aspect, the plant cell is from a plant selected from the group consisting of soybean, tobacco, sunflower, *Arabidopsis*, safflower, alfalfa, corn, wheat, rice, barley, oats, millet, canola, *Brassica*, cotton, and sugarcane. In an aspect, the *Ochrobactrum* is grown in the presence of acetosyringone or other compound that induces vir or r-vir gene function prior to contacting the plant cell. In an aspect, the plant cell is comprised of an explant from a plant seed, seedling, callus, cell suspension, cotyledon, meristem, leaf, root, or stem; and the explant is contacted with the *Ochrobactrum*. In an aspect, the explant comprises an embryonic meristem, a somatic meristem, callus, cell suspension; a cotyledon, a cotyledonary node, or comprises tissue from a leaf, a root, or a stem. In an aspect, identifying a plant cell comprising the sequence of interest is carried out in the absence of a selection agent. In an aspect, identifying a plant cell comprising the sequence of interest comprises culturing the plant cell in the presence of a selection agent, wherein the sequence of interest confers tolerance to the selection agent or is co-delivered with a selectable marker that confers tolerance to the selection agent. In an aspect, the selection agent is chlrosulfuron, ethametsulfuron, imazapyhr, glyphosate, kanamycin, spectinomycin, bialaphos, 2,4-D, or dicamba. In an aspect, the sequence of interest is not physically linked to a selectable marker gene. In an aspect, the marker gene and the sequence of interest genetically segregate in progeny of a plant regenerated from the plant cell comprising the sequence of interest. In an aspect, the *Ochrobactrum* further comprises a third vector in operable linkage comprising a second sequence of interest. In an aspect, regenerating a plant from the plant cell comprises inducing formation of one or more shoots from an explant comprising the plant cell and cultivating at least a first shoot into a whole fertile plant. In an aspect, regenerating a plant occurs by organogenesis. In an aspect, the *Ochrobactrum* is selected from the group consisting of *Ochrobactrum haywardense* H1, *Ochrobactrum cytisi*, *Ochrobactrum daejeonense*, *Ochrobactrum lupine*, *Ochrobactrum oryzae*, *Ochrobactrum tritici*, LBNL124-A-10, HTG3-C-07 and *Ochrobactrum pectoris*. In an aspect, the vector comprises any one of SEQ ID NO: 34, 35, 36, 106, 113 or 114, or variants and derivatives thereof.

In another aspect, the disclosure provides a kit comprising: (a) the *Ochrobactrum* of any of the compositions, the methods, or the vectors; and (b) instructions for use in transformation of a plant.

BRIEF DESCRIPTION OF THE FIGURES

The patent or application file contains at least one drawing executed in color. Copies of this patent or patent application publication with color drawing(s) will be provided by the Office upon request and payment of the necessary fee.

FIG. 2A-FIG. 2D show tabacco transformation experiments. Stably transformed shoots expressing DsRED (FIG. 2B) are shown from tobacco leaf discs transformed with *Ochrobactrum haywardense* H1 NRRL Deposit B-67078 further comprising PHP70365 three weeks after selection in bialaphos 3 mg/L medium. Stably transformed shoots expressing DsRED (FIG. 2D) are shown from tobacco leaf discs transformed with *Ochrobactrum haywardense* H1 NRRL Deposit B-67078 further comprising PHP70365 seven weeks after selection in bialaphos 3 mg/L medium. FIG. 2A (showing the tissue of FIG. 2B) and FIG. 2C (showing the tissue of FIG. 2D) show transformed tobacco shoots images using ambient light without the DsRED filter setting.

FIG. 3A-FIG. 3D show soybean half-seed explant transformation results. FIG. 3C and FIG. 3D show soybean half-seed explants transformed with *Ochrobactrum haywardense* H1 NRRL Deposit B-67078 further comprising PHP70365 showing transient expression of DsRED (FIG. 3D) five days after infection. FIG. 3C shows the soybean half seed explant tissue image of FIG. 3D under ambient light and FIG. 3D shows transient expression of DsRED5. In contrast, soybean half seed explants transformed with wild type *Ochrobactrum haywardense* H1 NRRL Deposit B-67078 without vector PHP70365 did not show DsRED expression (FIG. 3B).

FIG. 4A-FIG. 4J show sequential steps of soybean transformation infected with *Ochrobactrum haywardense* H1 NRRL Deposit B-67078 further comprising plasmid PHP70365 (pVIR8). FIG. 4A and FIG. 4B show shoot initiation of stably transformed shoots showing DsRED expression (FIG. 4B) observed two to four weeks after transformation. FIG. 4A shows the image of tissue from FIG. 4B but under ambient light. FIG. 4C shows shoot elongation in which the explants were subcultured for further shoot elongation. FIG. 4D-FIG. 4G show DsRed expression of soybean tissue. FIG. 4D and FIG. 4F were imaged under ambient light. FIG. 4E shows DsRed expression of the tissue of FIG. 4D. FIG. 4G shows DsRed expression of the tissue of FIG. 4F. FIG. 4H and FIG. 4I show rooting in which the entire plantlet produced roots that showed DsRED expression. FIG. 4H was imaged under ambient light. FIG. 4I shows DsRed expression of the tissue of FIG. 4H. FIG. 4J shows a potted soybean plant that was transformed with *Ochrobactrum haywardense* H1 NRRL Deposit B-67078 further comprising plasmid PHP70365.

FIG. 5A-FIG. 5D show soybean embryonic axis explants transformed with *Ochrobactrum haywardense* H1 NRRL Deposit B-67078 further comprising plasmid PHP70365. FIG. 5A shows shoot and callus initiation in which stably transformed shoots and callus showed DsRED expression (FIG. 5B) at the meristematic region observed two weeks after transformation. FIG. 5A shows the tissue image of FIG. 5B under ambient light. FIG. 5C and FIG. 5D show shoot elongation in which stably transformed DsRED positive shoots (FIG. 5D) 1-1.5 cm in size were produced six to eight weeks after transformation. FIG. 5C shows the tissue image of FIG. 5D under ambient light. FIG. 5A and FIG. 5B, bar equals 2 mm. FIG. 5C and FIG. 5D, bar equals 5 mm.

FIG. 6A-FIG. 6F show a comparison of transient expression of DsRED of *Ochrobactrum haywardense* H1 NRRL Deposit B-67078 (FIG. 6B), *Ochrobactrum cytisi* (FIG. 6D) and *Ochrobactrum pecoris* (FIG. 6F) in half seeds of soybean cultivar 93Y21 five days after infection. FIG. 6A, FIG. 6C, and FIG. 6E show the tissue images of FIG. 6B, FIG. 6D, and FIG. F, respectively, under ambient light.

DETAILED DESCRIPTION

*Ochrobactrum* is a bacterial genus in the Rhizobiales order, Brucellaceae family. *Ochrobactrum* strains are Gram-negative short rods, straight or slightly curved with one end flame-shaped. The cells are approximately 0.6 μm wide and 1.2 to 2 μm in length. *Ochrobactrum* are non-spore forming and are strictly aerobic and non-fermentative. The genomes of most *Ochrobactrum* species are complex with two independent circular chromosomes often associated to plasmids. The *Ochrobactrum* genus has been described by Holmes in 1988 (Holmes et al. (1988) Int J Syst Bacteriol 38:408) and *Ochrobactrum anthropi* was proposed as the type species of the genus. Further work led to the recognition of other species which include *O. ciceri, O. cytisi, O. daejeonense, O. gallinifaecis, O. grignonense, O. guangzhouense, O. haematophilum, O. intermedium, O. lupini, O. oryzae, O. pecoris, O. pituitosum, O. pseudintermedium, O. pseudogrignonense, O. rhizosphaerae, O. thiophenivorans*, and *O. tritici*.

In some examples of the present disclosure, an *Ochrobactrum* for transformation of cells is provided. In some examples, the *Ochrobactrum* is an *Ochrobactrum* grignonense. In some examples, the *Ochrobactrum* strain is *Ochrobactrum haywardense* H1 NRRL Deposit B-67078. *Ochrobactrum haywardense* H1 NRRL Deposit B-67078 may be referred to herein as *Ochrobactrum haywardense* H1 NRRL Deposit B-67078, *Ochrobactrum haywardense* H1, or EP1A09. In some examples, the *Ochrobactrum* vector comprises one or more virulence gene, a border region, and/or origin of replication. In some examples, the vector comprises a selectable marker(s) for plant and bacterial transformation. In some examples, one or more virulence genes is selected from the group consisting of virA, virB, virC, virD, virE, virF, virG, and variants thereof, and any combinations thereof. In some examples, one or more vir genes is selected from the group consisting of virA, virJ, virB1, virB2, virB3, virB4, virB5, virB6, virB7, virB8, virB9, virB10, virB11, virG, virC1, virC2, virD1, virD2, virD3, virD4, virD5, virE1, virE2, virE3 (Broothaerts et al., (2005) Nature 433: 629-633; US20050289667; US20050289672), and variants thereof, and any combinations thereof. In some examples, at least 2, 3, 4, 5, 6, 7 or 8 virulence genes are provided. In some examples, one or more virulence genes are provided on a Ti plasmid. In some examples, one or more virulence gene is incorporated into the *Ochrobactrum* genome. In some examples, the *Ochrobactrum* comprises more than one copy of one or more virulence genes. In some examples the *Ochrobactrum* comprises a first nucleic acid comprising a vir gene region of a Ti plasmid, wherein the vir gene region acts to introduce a nucleic acid coding for a sequence of interest into a plant cell in a VirD2-dependent manner. VirD2 is a bacterial endonuclease involved in nicking the border repeat sequence(s) on the T-DNA to produce the single-stranded DNA (ssDNA) molecule, with a single VirD2 protein covalently linked to the ssDNA (Young & Nester (1988) Journal of Bacteriology 170:3367-3374).

In some examples the *Ochrobactrum* comprises a nucleic acid comprising one or more T-DNA border sequence(s) operably linked to a nucleic acid coding for a sequence of interest. In some examples the *Ochrobactrum* comprises a nucleic acid comprising two or more T-DNA border sequence(s). In some examples the T-DNA border sequences are selected from the group consisting of a left border sequence, a right border sequence, and/or other sequences. In some examples the vir gene(s) and the sequence of interest are on a single polynucleotide molecule. In some examples the vir gene(s) and the sequence of interest are on separate polynucleotide molecules. Any origin(s) of replication functional in a bacterium can be used. In some examples, the origin(s) of replication is an origin that is functional in *Agrobacterium, E. coli*, or both. In some examples the origin(s) of replication is selected from the group consisting of pVS1, pSa, RK2, pRiA4b, incPa, incW, colE1, and functional variants or derivatives thereof. In some examples the *Ochrobactrum* comprises a Ti or Ri plasmid. In some examples the Ti or Ri plasmid is selected from the group consisting of pTiBo542, pTiC58, pTiAch5, pTiChrys5, pTF101.1, pBIN19, pUCD2, pCGN, and functional variants or derivatives or fragments thereof. In some examples, the *Ochrobactrum* further comprises a selectable marker. In some examples, the selectable marker is on the nucleic acid coding for the sequence of interest. In some examples the selectable marker is the sequence of interest.

Figure 1A:
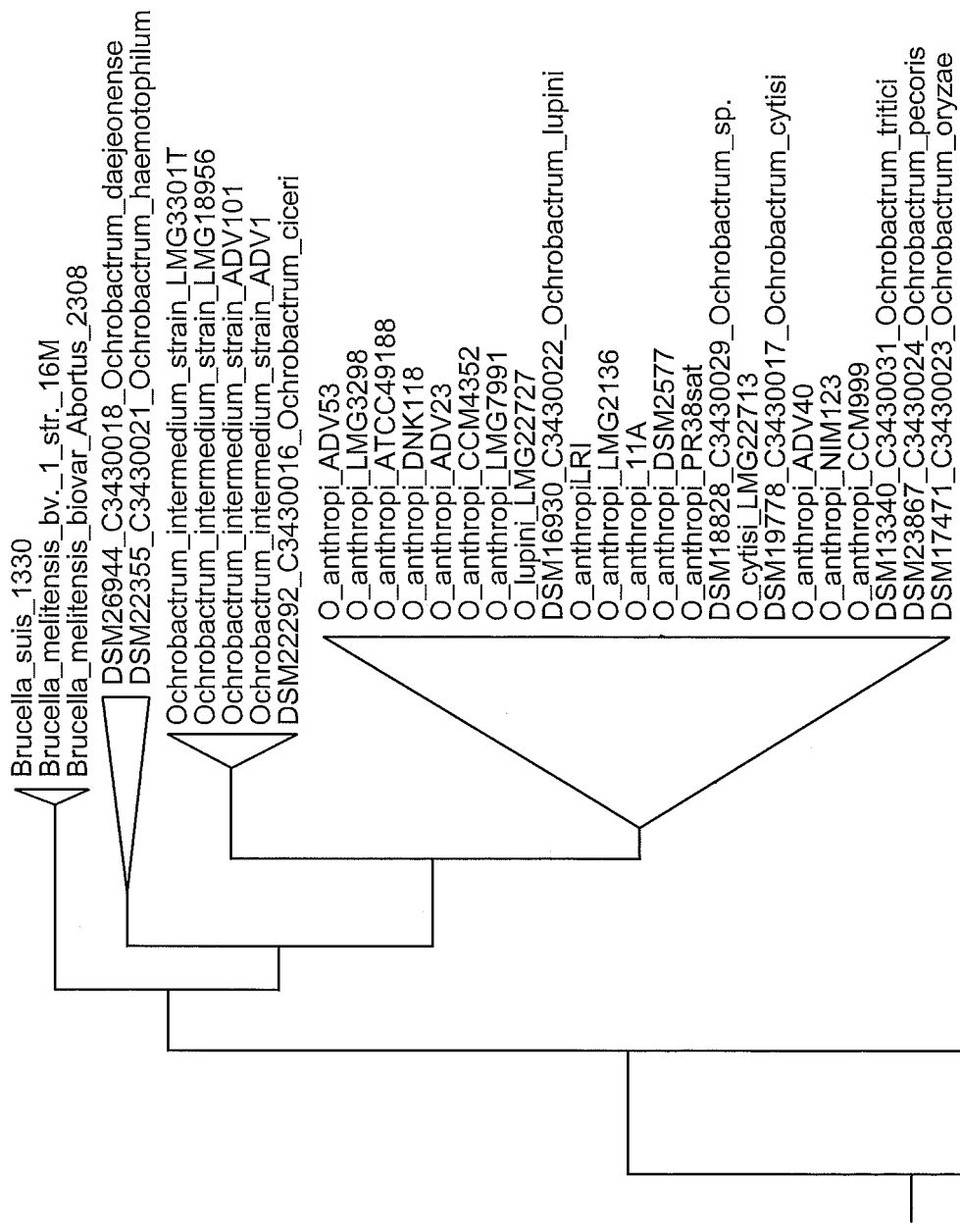
FIG. 1A and FIG. 1B show a molecular phylogenetic analysis based on 16S rDNA sequence using a maximum likelihood method, the arrow indicates the position of *Ochrobactrum haywardense* H1 (EP1A09).

By "fragment" is intended a portion of a polynucleotide or a portion of the amino acid sequence and hence protein encoded thereby. Fragments of a polynucleotide may encode protein fragments that retain the biological activity of the native protein. Thus, fragments of a nucleotide sequence may range from at least about 10 nucleotides, about 15 nucleotides, about 16 nucleotides, about 17 nucleotides, about 18 nucleotides, about 19 nucleotides, about 20 nucleotides, about 22 nucleotides, about 50 nucleotides, about 75 nucleotides, about 100 nucleotides, about 200 nucleotides, about 300 nucleotides, about 400 nucleotides, about 500 nucleotides, about 600 nucleotides, and up to the full-length polynucleotide employed.

By "derivative" is intended a polynucleotide or a portion of a polynucleotide that possesses activity that is substantially similar to the biological activity of the reference polynucleotide. A derivative of a virulence gene polynucleotide will be functional and will retain the virulence gene activity.

"Variant" is intended to mean a substantially similar sequence. For polynucleotides, a variant comprises a deletion and/or addition and/or substitution of one or more nucleotides at one or more internal sites within the native polynucleotide and/or a substitution of one or more nucleotides at one or more sites in the native polynucleotide. A variant of a virulence gene polynucleotide will retain the virulence gene activity. As used herein, a "native" polynucleotide or polypeptide comprises a naturally occurring nucleotide sequence or amino acid sequence, respectively. For polynucleotides, conservative variants include those sequences that, because of the degeneracy of the genetic code, encode the amino acid sequence of a polypeptide encoded by a virulence gene. Variant polynucleotides also include synthetically derived polynucleotide, such as those generated, for example, by using site-directed mutagenesis, but continue to retain the desired activity. Generally, variants of a particular disclosed polynucleotide (i.e., a virulence gene) will have at least about 40%, 45%, 50%, 55%, 60%, 65%, 70%, 75%, 80%, 85%, 90%, 91%, 92%, 93%, 94%, 95%, 96%, 97%, 98%, 99% or more sequence identity to that particular polynucleotide as determined by sequence alignment programs and parameters described elsewhere herein. Variants of a particular disclosed polynucleotide (i.e., the reference polynucleotide) can also be evaluated by comparison of the percent sequence identity between the polypeptide encoded by a variant polynucleotide and the polypeptide encoded by the reference polynucleotide. Percent sequence identity between any two polypeptides can be calculated using sequence alignment programs and parameters described elsewhere herein. Where any given pair of disclosed polynucleotides employed is evaluated by comparison of the percent sequence identity shared by the two polypeptides they encode, the percent sequence identity between the two encoded polypeptides is at least about 40%, 45%, 50%, 55%, 60%, 65%, 70%, 75%, 80%, 85%, 90%, 91%, 92%, 93%, 94%, 95%, 96%, 97%, 98%, 99% or more sequence identity.

As used herein, "pPHP" refers to plasmid PHP, which is than followed by numerical digits. For example, pPHP70365 refers to plasmid PHP70365. For example, pVIR7 refers to plasmid VIR7.

Table 19 provides a list of sequence identification numbers (SEQ ID NO:) provided in this disclosure.

Also provided are methods to transform a cell. In some examples, the cell is a plant cell. In some examples, the method comprises contacting a cell with an *Ochrobactrum* comprising one or more of a virulence gene, a border region, and/or origin of replication, and a sequence of interest; culturing the plant cell under conditions allowing *Ochrobactrum* to transfer the sequence of interest to the cell; and, identifying a transformed cell comprising the sequence of interest in its genome. In some examples, the cell is a plant cell, and the method further comprises regenerating a plant comprising the sequence of interest in its genome. In some examples, the *Ochrobactrum* is *Ochrobactrum haywardense* H1 NRRL Deposit B-67078. In some examples, the *Ochrobactrum* is *Ochrobactrum* grignonense, *Ochrobactrum cytisi*, or *Ochrobactrum* pectoris. In some examples, the plant cell is from a monocot or a dicot. In some examples the plant cell is from a plant selected from the group consisting of soybean, tobacco, sunflower, *Arabidopsis*, safflower, alfalfa, corn, wheat, rice, sorghum. barley, oats, millet, canola, *Brassica*, cotton, and sugarcane. In some examples, the *Ochrobactrum* is grown in the presence of acetosyringone or other compound that induces vir gene function prior to contacting the cell.

In some examples, the plant cell is comprised of an explant from a plant seed, a seedling, callus, a cell suspension, a cotyledon, a meristem, a leaf, a root, or a stem; and the explant is contacted with the *Ochrobactrum*. In some examples the explant comprises an embryonic meristem, a somatic meristem, callus, cell suspension, a cotyledon, a cotyledonary node, or comprises tissue from a leaf, a root, or a stem. In some examples, identifying a plant cell comprising the sequence of interest is carried out in the absence of a selection agent. In other examples, identifying a plant cell comprising the sequence of interest comprises culturing the plant cell in the presence of a selection agent, wherein the sequence of interest confers tolerance to the selection agent or is co-delivered with a selectable marker that confers tolerance to the selection agent. In some examples, the selection agent is glyphosate, kanamycin, bialaphos, 2,4-D, or dicamba. In some examples the sequence of interest is not physically linked to a selectable marker gene. In these examples, the marker gene and the sequence of interest genetically segregate in progeny of a plant regenerated from the plant cell comprising the sequence of interest. In some examples the *Ochrobactrum* further comprises a third nucleic acid comprising a second sequence of interest, and whereby the transformed cell comprises the second sequence of interest in its genome. In some examples, regenerating a plant from the plant cell comprises inducing formation of one or more shoots from an explant comprising the plant cell and cultivating at least a first shoot into a whole fertile plant. In some examples, regeneration occurs by organogenesis.

The bacterial order Rhizobiales comprises common soil bacteria and along with *Agrobacterium* spp. includes *Rhizobium* spp., *Mesorhizobium* spp., *Sinorhizobium* spp., and *Ochrobactrum* spp. Besides *Agrobacterium* sp., other members of the Rhizobiales such as *Rhizobium* spp., are known to symbiotically associate with plant roots in specialized nitrogen-fixing nodules (e.g., Long (2001) Plant Physiol 125:69-72). In addition to host-specific nodulation of plant roots, especially of legumes, some plant growth promoting effects by members of the Rhizobiales are known in the absence of nodulation (e.g., Noel et al. (1996) Can J Microbiol 42:279-283). Reports have been published describing transformation of plants by bacteria other than *Agrobacterium* sp. (e.g. Broothaerts et al. (2005) Nature 433:629-633; US20050289667; US20050289672; Weller et al. (2004) Appl Env Microbiol 70:2779-2785; Weller et al. (2005) Pl Pathol 54:799-805). Transformation of plants has been shown for *Agrobacterium, Rhizobium, Sinorhizobium*, and Ensifer in the Rhizobiaceae family, while DNA transfer has only been shown for *Mezorhizobium* in the Phyllobacteriaceae family.

In aspects, the Rhizobiaceae virulence genes are *Agrobacterium* spp., *Rhizobium* spp., *Sinorhizobium* spp., *Mesorhizobium* spp., *Phyllobacterium* spp., *Ochrobactrum* spp., or *Bradyrhizobium* spp. genes. In an aspect, the Rhizobiaceae virulence genes are *Rhizobium* spp. genes. In an aspect, the Rhizobiaceae virulence genes are *Sinorhizobium* spp. genes. In an aspect, the Rhizobiaceae virulence genes are *Mesorhizobium* spp. genes. In an aspect, the Rhizobiaceae virulence genes are *Phyllobacterium* spp. genes. In an aspect, the Rhizobiaceae virulence genes are *Ochrobactrum* spp. genes. In an aspect, the Rhizobiaceae virulence genes are *Bradyrhizobium* spp. genes.

In aspects, the Rhizobiaceae virulence genes are *Agrobacterium* spp. genes. In an aspect, the *Agrobacterium* spp. genes are *Agrobacterium albertimagni, Agrobacterium larrymoorei, Agrobacterium radiobacter, Agrobacterium rhizogenes, Agrobacterium rubi, Agrobacterium tumefaciens*, or *Agrobacterium vitis* genes. In an aspect, the *Agrobacterium* spp. genes are *Agrobacterium rhizogenes* or *Agrobacterium tumefaciens*. In an aspect, the *Agrobacterium* spp. genes are *Agrobacterium rhizogenes*. In an aspect, the *Agrobacterium* spp. genes are *Agrobacterium tumefaciens*.

A number of wild-type and disarmed (non-pathogenic) strains of *Agrobacterium tumefaciens* and *Agrobacterium rhizogenes* harboring Ti or Ri plasmids can be used for gene transfer into plants. Phytohormone synthesis genes located in the T-DNA of wild type Agrobacteria harboring a Ti or Ri plasmid are expressed in plant cells following transformation, and cause tumor formation or a hairy root phenotype depending on the *Agrobacterium* strain or species. The T-DNA of Agrobacteria can be engineered to replace many of its virulence and pathogenicity determinants (by disarming) with one or more sequences of interest and retain the ability to transfer the modified T-DNA into a plant cell and be integrated into a genome. Strains containing such disarmed Ti plasmids are widely used for plant transformation.

In some aspects, a vector construct comprises a Ti plasmid (*Agrobacterium tumefaciens*) or a Ri plasmid (*Agrobacterium rhizogenes*). In some aspects, the construct comprises one or more virulence genes. The virulence genes can be from a Ti plasmid and are represented herein as SEQ ID NOS: 4-27 and SEQ ID NOS: 42-49 (see Table 19 herein). The virulence genes can be from a Ri plasmid and are represented herein as SEQ ID NOS: 79-101. The Ri plasmid virulence genes disclosed herein are represented using a "r" before the vir gene name. For example, r-virA (SEQ ID NO: 79), r-virB1 (SEQ ID NO: 80), r-virB2 (SEQ ID NO: 81), r-virB3 (SEQ ID NO: 82), r-virB4 (SEQ ID NO: 83), r-virB5 (SEQ ID NO: 84), r-virB6 (SEQ ID NO: 85), r-virB7 (SEQ ID NO: 86), r-virB8 (SEQ ID NO: 87), r-virB9 (SEQ ID NO: 88), r-virB10 (SEQ ID NO: 89), r-virB11 (SEQ ID NO: 90), r-virG (SEQ ID NO: 91), r-virC1 (SEQ ID NO: 92), r-virC2 (SEQ ID NO: 93), r-virD1 (SEQ ID NO: 94), r-virD2 (SEQ ID NO: 95), r-virD3 (SEQ ID NO: 96), r-virD4 (SEQ ID NO: 97), r-virD5 (SEQ ID NO: 98), r-virF (SEQ ID NO: 99), r-virE3 (SEQ ID NO: 100), and r-galls (SEQ ID NO: 101). See Table 19 herein. Different combinations of the virulence genes (vir and r-vir) may be used herein. The r-galls gene (SEQ ID NO: 101) is necessary for virulence with the Ri plasmid vir genes described herein.

In an aspect, the vector further comprises one or more *Agrobacterium* virulence genes virA, virD3, virD4, virD5, virE1, virE2, virE3, virH, virH1, virH2, vir J, virK, virL, virM, virP, or virQ, or variants and derivatives thereof, or one or more *Agrobacterium* virulence genes r-virA, r-virD3, r-virD4, r-virD5, r-virE3, or r-virF, or variants and derivatives thereof, and r-galls, or variants and derivatives thereof.

An *Ochrobactrum* used in the present disclosure may comprise nucleic acids introduced, for example, by electroporation. The introduced nucleic acids may comprise polynucleotides required for conjugative transfer independent of VirD2 function, or one or more virulence genes. The introduced sequences may be inserted into the *Ochrobactrum* genome. In other examples, the introduced sequences are on one or more plasmids. In other examples, polynucleotides can be transferred to *Ochrobactrum* by conjugal transfer from another bacterial species. For example, other than the T4SS-dependent T-strand delivery system, *Agrobacterium* has additional plasmid mobilization systems that can also transfer and integrate plasmids, such as the IncQ plasmid pRFS1010, between bacterial cells and into the plant genome via conjugal transfer (Buchanan-Wollaston et al. (1987) Nature 328:172-175, Shadenkov et al. (1996) Mol Biol 30:272-275; Chen et al. (2002) J Bacteriol 184:4838-4845). Furthermore, the conjugal transfer protein MobA, in conjunction with MobB and MobC proteins of the RFS1010 plasmid, cleaves the oriT (origin of transfer) site, attaches to the 5' end and transfers the ssDNA into cells independent of the T4SS system (Bravo-Angel (1999) J Bacteriol 181:5758-5765, and references therein). Conjugal transfer systems are widely present in bacteria, resulting in exchange of genetic information between bacterial cells. In *Rhizobium*, wherein *Rhizobium* is phylogenetically related but distinct from *Agrobacterium* (see, e.g., Spaink et al. (ed.), The Rhizobiaceae, Kluwer Academic Publishers, Dordrecht, The Netherlands, 1998; and, Farrand et al. (2003) Int J Syst Evol Microbiol. 53:1681-1687), the conjugal transfer system has been partially characterized in some species (see, e.g., Freiberg et al. (1997) Nature 387:394-401; Turner et al. (2002) FEMS Microbiol Ecol 42:227-234; Tun-Garrido et al. (2003) J Bacteriol 185:1681-1692; and, Perez-Mendoza et al. (2004) J Bacteriol 186:5753-5761). The conjugal system uses an oriT as the nicking site and TraA or Mob as a nicking enzyme, in contrast to the conventional elements used in T-DNA mobilization (VirD2 and RB and LB sites, respectively). Unlike VirD2, which was found to have plant nuclear localization signal (NLS) at its C-terminus for plant nuclear targeting, neither TraA nor Mob has an obvious NLS.

The Vir region on the Ti/Ri plasmid is a collection of genes whose aggregate function is to excise the T-DNA region of the plasmid and promote its transfer and integration into the plant genome. The vir system is induced by signals produced by plants in response to wounding. Phenolic compounds such as acetosyringone, syringealdehyde, or acetovanillone activate the virA gene, which encodes a receptor that is a constitutively expressed trans-membrane protein. The activated virA gene acts as a kinase, phosphorylating the virG gene. In its phosphorylated form, virG acts as a transcriptional activator for the remaining vir gene operons. The virB operon encodes proteins which produce a pore/pilus-like structure. VirC binds to the overdrive sequence. VirD1 and virD2 have endonuclease activity, and make single-stranded cuts within the left and right borders, and virD4 is a coupling protein. VirE binds to the single stranded T-DNA, protecting it during the transport phase of the process. Once in the plant cell, the complementary strand of the T-DNA is synthesized.

These and other vir genes, function in trans, so none of these genes need to be included in the cloning vectors. For example, modified *Agrobacterium* strains can provide all the necessary Vir functions on plasmids where the T-DNA region has been deleted, allowing the cell to provide the vir functions for T-DNA transfer. In one example, there are C58-derived strains in which a portion of pBR322 (Bolivar et al., (1977). Gene. 2 (2): 75-93; Bolivar et al (1977) Gene 2 (2): 95-113 was used to replace the T-DNA region, and providing resistance to ampicillin.

In designing a vector construct for the transformation process, one or more genetic components are selected that will be introduced into the plant cell or tissue. Genetic components can include any nucleic acid that is introduced into a plant cell or tissue using the *Ochrobactrum* compositions and/or methods. Genetic components can include non-plant DNA, plant DNA or synthetic DNA. In some examples, the genetic components are incorporated into a DNA molecule such as a recombinant, double-stranded plasmid or vector molecule comprising at least one or more of the following genetic components: a promoter that functions in plant cells to cause the production of an RNA sequence; a structural DNA sequence that causes the production of an RNA sequence; and, 3' non-translated DNA sequence that directs polyadenylation of the 3' end of the RNA sequence.

Provided are constructs which include one or more sequence of interest for expression and/or insertion in a cell genome. The constructs may be contained within a vector such as binary (U.S. Provisional Appln. No. 62/252,229 incorporated herein by reference in its entirety), ternary or T-DNA vectors. A construct refers to a polynucleotide molecule comprised of various types of nucleotide sequences having different functions and/or activities. Various types of sequences include linkers, adapters, regulatory regions, introns, restriction sites, enhancers, insulators, screenable markers, selectable markers, promoters, expression cassettes, coding polynucleotides, silencing polynucleotides, termination sequences, origins of replication, recombination sites, excision cassettes, recombinases, cell proliferation factors, promoter traps, other sites that aid in vector construction or analysis, or any combination thereof. In some examples a construct comprises one or more expression cassettes, wherein a polynucleotide is operably linked to a regulatory sequence. Operably linked is a functional linkage between two or more elements. For example, an operable linkage between a coding polynucleotide and a regulatory sequence (e.g., a promoter) is a functional link that allows for expression of the coding polynucleotide. Operably linked elements may be contiguous or non-contiguous. When used to refer to the joining of two protein coding regions, by operably linked is intended that the coding regions are in the same reading frame. A coding polynucleotide includes any polynucleotide that either encodes a polypeptide, or that encodes a silencing polynucleotide that reduces the expression of target genes. Non-limiting examples of a silencing polynucleotide include a small interfering RNA, micro RNA, antisense RNA, a hairpin structure, and the like. The construct may also contain a number of genetic components to facilitate transformation of the plant cell or tissue and to regulate expression of any structural nucleic acid sequence. In some examples, the genetic components are oriented so as to express a mRNA, optionally the mRNA is translated into a protein. The expression of a plant structural coding sequence (a gene, cDNA, synthetic DNA, or other DNA) that exists in double-stranded form involves transcription of messenger RNA (mRNA) from one strand of the DNA by RNA polymerase enzyme and subsequent processing of the mRNA primary transcript inside the nucleus. This processing involves a 3' non-translated region that polyadenylates the 3' ends of the mRNA.

The mechanism of T-DNA transfer to plant cells by *Agrobacterium* is well known. Briefly, the T-DNA is delimited by two border region sequences, the right border (RB) and left border (LB). These borders are nicked by virulence protein VirD2 to produce a single stranded transferred DNA (the "T-strand") with covalent attachment of the VirD2 on its 5' end. The protein-DNA complex, also including *Agrobacterium* VirE2 protein, exits *Agrobacterium* cells via the Type 4 secretion system which includes both virulence protein and a ssDNA transporter, and is transferred into plant cells. The transferred DNA undergoes further processing in the plant cell and is integrated in the plant genome with the help of both *Agrobacterium* virulence proteins and plant factors. The use of *Agrobacterium*-mediated vectors to introduce DNA into plant cells is well known in the art. (See, e.g., Fraley et al. (1985) Bio/Technology 3:629-635; Rogers et al. (1987) Methods Enzymol 153:253-277; and U.S. Pat. No. 5,563,055, incorporated herein by reference in its entirety). These same elements and mechanisms can be transferred to produce a system for transforming plant cells.

In some examples, a construct comprises a Ti or Ri plasmid. In some examples, the construct comprises one or more virulence genes. In some examples, the Ti or Ri plasmid is pC5105, pC5106, or a variant or derivative thereof. In some examples, the construct provided is competent for virD2-independent transfer from *Ochrobactrum* and lacking T-DNA border sequence, the construct comprising an oriT sequence and traA or mob sequence, optionally operably linked to a sequence of interest. An *Ochrobactrum* transformed with such a construct is also provided. In some examples, the *Ochrobactrum* comprises a Ti plasmid containing a region of T-DNA, wherein the sequence of interest is located within the T-DNA, optionally between the left and right borders of the T-DNA. Appropriate reporter genes include GUS or a fluorescent protein, including but not limited to GFP, YFP, CFP, RFP, DsRed, ZsGreen, ZsYellow, and the like.

In some examples, a transformation method provided herein may comprise selecting a plant cell transformed with a sequence of interest in the absence of a selection agent.

Selecting a plant cell transformed with a sequence of interest may comprise culturing the plant cell in the presence of a selection agent, wherein the sequence of interest confers tolerance to the selection agent or is operably linked to a further nucleic acid that confers tolerance to the selection agent. Examples of such selection agents include glyphosate, kanamycin, bialaphos or dicamba. In yet other aspects, the sequence of interest is not physically linked to a selectable marker gene. For example, the marker gene and sequence of interest may genetically segregate in progeny of a plant regenerated from the plant cell transformed with the sequence of interest.

A plant growth regulator or a plant hormone includes compounds that affect plant growth. Plant growth regulators include, but are not limited to, auxins, cytokinins, ABA, gibberellins, ethylene, brassinosteroids, and polyamines. Auxins affect the elongation of shoots and roots at low concentration but inhibit growth at higher levels. Commonly used auxins include picloram (4-amino-3,5,6-trichloropicolinic acid), 2,4-D (2,4-dichlorophenoxyacetic acid), IAA (indole-3-acetic acid), NAA (a-naphthaleneacetic acid), and dicamba (3,6-dichloroanisic acid). Cytokinins cause cell division, cell differentiation, and shoot differentiation. Commonly used cytokinins include kinetin, BA (6-benzylaminopurine), 2-ip (2-isopentenyladenine), BAP (6-benzylaminopurine), thidiazuron (TDZ), zeatin riboside, and zeatin.

Transformation refers to a process of introducing an exogenous nucleic acid sequence into a cell or tissue. The transformation may be transient or stable. In stable transformations, part or all of the exogenous nucleic acid is incorporated (e.g., integrated or stably maintained) in the nuclear genomic DNA, plastid DNA, or is capable of autonomous replication in the nucleus or plastid.

The term polynucleotide is not limited to compositions comprising only DNA. Polynucleotides can comprise ribonucleotides or peptide nucleic acids, and combinations of ribonucleotides, deoxyribonucleotides, and peptide nucleic acids. Such deoxyribonucleotides and ribonucleotides include both naturally occurring molecules, synthetic analogues, and modified molecules. The polynucleotides also encompass all forms of sequences including, but not limited to, single-, double-, or multi-stranded forms, hairpins, stem-and-loop structures, circular plasmids, and the like.

A variety of methods and commercial systems for preparing constructs such as cassettes, plasmids or vectors containing the desired genetic components are well known in the art. Constructs typically consist of a number of genetic components, including but not limited to regulatory elements such as promoters, leaders, introns, and terminator sequences. Regulatory elements are also referred to as cis- or trans-regulatory elements, depending on the proximity of the element to the sequence gene(s) they control.

In some examples a construct comprises a promoter operably linked to a coding polynucleotide. The term promoter indicates a region of DNA involved in the recognition and binding of RNA polymerase and other proteins to initiate transcription of a coding sequence. Promoters may be naturally occurring promoters, a variant or a fragment thereof, or synthetically derived. The term promoter refers to the minimal sequences necessary to direct transcription (minimal promoter) as well as sequences comprising the minimal promoter and any number of additional elements, such as operator sequences, enhancers, modulators, restriction sites, recombination sites, sequences located in between the minimal promoter and the coding sequence, and sequences of the 5'-untranslated region (5'-UTR), which is the region of a transcript that is transcribed, but is not translated into a polypeptide, which may or may not influence transcription levels in a desired manner. A plant promoter refers to a promoter isolated from a plant or a promoter derived therefrom or a heterologous promoter that functions in a plant, for example a promoter from a plant virus. The promoter may be selected based on the desired outcome or expression pattern (for a review of plant promoters, see Potenza et al. (2004) In Vitro Cell Dev Biol 40:1-22).

A number of promoters that are active in plant cells have been described in the art. A variety of promoters that are regulated in response to environmental, hormonal, chemical, and/or developmental signals, also can be used for expression of any construct in plant cells, including, for instance, promoters regulated by heat (e.g., Callis et al. (1988) Plant Physiol 88:965-968, light (e.g., pea RbcS-3A promoter, Kuhlemeier et al. (1989) Plant Cell 1:471-478; and, maize RbcS promoter, Schaffner et al. (1991) Plant Cell 3:997-1012), hormones, such as abscisic acid (Marcotte et al. (1989) Plant Cell 1:969-976), wounding (e.g., Wuni et al. (1989) Plant Cell 1:961-968), or other signals or chemicals. Examples describing promoters include without limitation U.S. Pat. No. 6,437,217 (maize RS81 promoter), U.S. Pat. No. 5,641,876 (rice actin promoter, OsActl), U.S. Pat. No. 6,426,446 (maize RS324 promoter), U.S. Pat. No. 6,429,362 (maize PR-1 promoter), U.S. Pat. No. 6,232,526 (maize A3 promoter), U.S. Pat. Nos. 5,322,938, 5,352,605, 5,359,142 and 5,530,196 (35S promoter, 35Senh), U.S. Pat. No. 6,433,252 (maize L3 oleosin promoter), U.S. Pat. No. 6,429,357 (rice actin 2 promoter, and rice actin 2 intron), U.S. Pat. No. 5,837,848 (root specific promoter), U.S. Pat. No. 6,294,714 (light inducible promoters), U.S. Pat. No. 6,140,078 (salt inducible promoters), U.S. Pat. No. 6,252,138 (pathogen inducible promoters), U.S. Pat. No. 6,175,060 (phosphorus deficiency inducible promoters), U.S. Pat. No. 6,635,806 (gamma-coixin promoter), and U.S. Pat. No. 7,151,204 (maize chloroplast aldolase promoter). Additional promoters that may find use are a nopaline synthase (NOS) promoter (Ebert et al. (1987) PNAS 84:5745-5749), the octopine synthase (OCS) promoter (from tumor-inducing plasmids of *A. tumefaciens*), the caulimovirus promoters such as the cauliflower mosaic virus (CaMV) 19S promoter (Lawton et al. (1987) Plant Mol Biol 9:315-324), the CaMV 35S promoter (Odell et al. (1985) Nature 313:810-812), the figwort mosaic virus 35S-promoter (Walker et al. (1987) PNAS 84:6624; U.S. Pat. Nos. 6,051,753; 5,378,619), the sucrose synthase promoter (Yang et al. (1990) PNAS 87:4144-4148), the R gene complex promoter (Chandler et al. (1989) Plant Cell 1:1175-1183), chlorophyll a/b binding protein gene promoter, or peanut chlorotic streak caulimovirus promoter PClSV (U.S. Pat. No. 5,850,019). In some examples, At.Act 7 (Accession #U27811), At.ANTI (US20060236420), FMy'35S-EFla (US20050022261), eIF4A10 (Accession #X79008) and AGRtu.nos (GenBank Accession V00087; Depicker et al. (1982) J Mol Appl Genet 1:561-573; Bevan et al. (1983) Nature 304:184-187), rice cytosolic triose phosphate isomerase (OsTPI; U.S. Pat. No. 7,132,528), and rice actin 15 gene (OsAct15; US20060162010) promoters may be used. In some instances, a promoter may include a 5'UTR and/or a first intron.

Constitutive promoters include, for example, the core promoter of the Rsyn7 promoter and other constitutive promoters disclosed in WO1999/43838 and U.S. Pat. No. 6,072,050; the core CaMV 35S promoter (Odell et al. (1985) Nature 313:810-812); rice actin (McElroy et al. (1990) Plant Cell 2:163-171); ubiquitin (Christensen et al. (1989) Plant Mol Biol 12:619-632; and, Christensen et al. (1992) Plant Mol Biol 18:675-689); pEMU (Last et al. (1991) Theor Appl Genet 81:581-588); MAS (Velten et al. (1984) EMBO J 3:2723-2730); ALS promoter (U.S. Pat. No. 5,659,026), the *Agrobacterium* nopaline synthase (NOS) promoter (Bevan et al. (1983) Nucl Acids Res 11:369-385); *Mirabilis* mosaic virus (MMV) promoter (Dey & Maiti (1999) Plant Mol Biol 40:771-782; Dey & Maiti (1999) Transgenics 3:61-70); histone 2B (H2B) (WO1999/43797); banana streak virus (BSV) promoter (Remans et al. (2005) Virus Research 108:177-186); chloris striate mosaic virus (CSMV) promoter (Zhan et al. (1993) Virology 193:498-502); Cassava vein mosaic virus (CSVMV) promoter (Verdaguer et al. (1998) Plant Mol Biol 37:1055-1067); figwort mosaic virus (FMV) promoter (U.S. Pat. No. 6,018,100); rice alpha-tubulin (OsTUBA1) promoter (Jeon et al. (2000) Plant Physiol 123:1005-1014); rice cytochrome C (OsCC1) promoter (Jang et al. (2002) Plant Physiol 129:1473-1481); maize alcohol dehydrogenase1 (ZmADH1) promoter (Kyozuka et al. (1990) Maydica 35:353-357); an oleosin promoter, and the like; each of which is herein incorporated by reference in its entirety. Other constitutive promoters are described in, for example, U.S. Pat. Nos. 5,608,149; 5,608,144; 5,604,121; 5,569,597; 5,466,785; 5,399,680; 5,268,463; 5,608,142; and 6,177,611; each of which is herein incorporated by reference in its entirety.

In some examples, an inducible promoter may be used in the compositions and/or methods. Wound-inducible promoters, which may respond to damage caused by insect feeding, include the potato proteinase inhibitor (pin II) gene promoter; wun1 and wun2 disclosed in U.S. Pat. No. 5,428,148, the entire disclosure of which is herein incorporated by reference; systemin; WIP1; MPI gene promoter and the like. Additionally, pathogen-inducible promoters may be employed, such pathogen-inducible promoters include those from pathogenesis-related proteins (PR proteins), which are induced following infection by a pathogen; for example, but not limited to, PR proteins, SAR proteins, beta-1,3-glucanase, and chitinase. See, for example, WO1999/43819, the entire disclosure of which is herein incorporated by reference. Promoters that are expressed locally, at or near the site of pathogen infection, can be used. See, for example, U.S. Pat. No. 5,750,386 (nematode-inducible) the entire disclosure of which is herein incorporated by reference; and the inducible promoter for the maize PRms gene, whose expression is induced by the pathogen *Fusarium moniliforme*.

Chemical-regulated promoters can be used to modulate the expression of a gene in a cell or plant through the application of an exogenous chemical regulator. The promoter may be a chemical-inducible promoter, where application of the chemical induces gene expression, or a chemical-repressible promoter, where application of the chemical represses gene expression. Chemical-inducible promoters are known in the art and include, but are not limited to, the maize In2-2 promoter, which is activated by benzenesulfonamide herbicide safeners, the maize GST promoter, which is activated by hydrophobic electrophilic compounds that are used as pre-emergent herbicides, and the tobacco PR-1a promoter, which is activated by salicylic acid. Other chemical-regulated promoters of interest include steroid-responsive promoters such as the glucocorticoid-inducible promoter and the tetracycline-inducible and tetracycline-repressible promoters (see, for example, U.S. Pat. Nos. 5,814,618 and 5,789,156, the entire disclosures of which are herein incorporated by reference).

Tissue-preferred promoters can be utilized to target enhanced polypeptide expression within a particular plant tissue. Tissue-preferred promoters are known in the art and include those promoters which can be modified for weak expression. Leaf-preferred, root-preferred or root-specific promoters can be selected from those known in the art, or isolated de novo from various compatible species. Examples of root-specific promoters include those promoters of the soybean glutamine synthetase gene, the control element in the GRP 1.8 gene of French bean, the mannopine synthase (MAS) gene of *Agrobacterium tumefaciens*, and the full-length cDNA clone encoding cytosolic glutamine synthetase (GS). Root-specific promoters also include those isolated from hemoglobin genes from the nitrogen-fixing nonlegume *Parasponia andersonii* and the related non-nitrogen-fixing nonlegume *Trema tomentosa*, promoters of the highly expressed rolC and rolD root-inducing genes of *Agrobacterium rhizogenes*, the root-tip specific promoter of octopine synthase, and the root-specific promoter of the TR2' and TR1'genes. Additional root-preferred promoters include the VfENOD-GRP3 gene promoter and rolB promoter. See, e.g., U.S. Pat. Nos. 5,837,876; 5,633,363; 5,459,252; 5,401,836; 5,110,732 and 5,023,179, the entire disclosures of each are herein incorporated by reference. *Arabidopsis thaliana* root-preferred regulatory sequences are disclosed in US20130117883, the entire disclosure of which is herein incorporated by reference.

Seed-preferred promoters include both seed-specific promoters (those promoters active during seed development such as promoters of seed storage proteins) as well as seed-germinating promoters (those promoters active during seed germination). Such seed-preferred promoters include, but are not limited to, Cim1 (cytokinin-induced message); cZ19B1 (maize 19 kDa zein); and milps (myo-inositol-1-phosphate synthase) (see, U.S. Pat. No. 6,225,529, the entire disclosure of which is herein incorporated by reference). Gamma-zein and Glb-1 are endosperm-specific promoters. For dicots, seed-specific promoters include, but are not limited to, Kunitz trypsin inhibitor 3 (KTi3), bean β-phaseolin, napin, β-conglycinin, glycinin 1, soybean lectin, cruciferin, and the like. For monocots, seed-specific promoters include, but are not limited to, maize 15 kDa zein, 22 kDa zein, 27 kDa zein, γ-zein, waxy, shrunken 1, shrunken 2, globulin 1, etc. In dicots, seed specific promoters include, but are not limited to, the seed coat promoter from *Arabidopsis*, pBAN; and the early seed promoters from *Arabidopsis, p26, p63*, and p63tr (U.S. Pat. Nos. 7,294,760 and 7,847,153, the entire disclosures of which are herein incorporated by reference). A promoter that has "preferred" expression in a particular tissue is expressed in that tissue to a greater degree than in at least one other plant tissue. Some tissue-preferred promoters show expression almost exclusively in the particular tissue.

Promoter chimeras can also be constructed to enhance transcriptional activity (U.S. Pat. No. 5,106,739), or to combine desired transcriptional activity, inducibility, tissue specificity, developmental specificity or any combination thereof. Promoters that function in plants include but are not limited to promoters that are inducible, viral, synthetic, constitutive, temporally regulated, spatially regulated, and/or spatio-temporally regulated. Other promoters that are tissue-enhanced, tissues specific, and/or developmentally regulated are also known in the art and can be used with the compositions and/or methods provided herein.

The promoters used in the DNA constructs (i.e., chimeric/recombinant plant genes) may be modified, if desired, to affect control or expression characteristics. Promoters can be derived by means of ligation with operator regions, random or controlled mutagenesis, or other means. Furthermore, the promoters may be altered to contain multiple enhancer sequences to assist in elevating gene expression.

Termination of transcription may be accomplished by a 3' non-translated DNA sequence operably linked to a sequence of interest or other sequence. The 3' non-translated region of a recombinant DNA molecule contains a polyadenylation signal that functions in plants to cause the addition of adenylate nucleotides to the 3' end of the RNA. The termination region can be obtained from various genes that are expressed in plant cells and may be native with the transcriptional initiation region, the operably linked polynucleotide, and/or the host cell, or the termination region may be derived from another source (i.e., foreign or heterologous) to the promoter, the polynucleotide, the host cell, or any combination thereof. Convenient termination regions are available from the potato proteinase inhibitor (PinII) gene or the Ti-plasmid of *A. tumefaciens*, such as the octopine synthase and nopaline synthase termination regions (Fraley et al. (1983) PNAS 80:4803-4807). See also Guerineau et al. (1991) Mol Gen Genet 262:141-144; Proudfoot (1991) Cell 64:671-674; Sanfacon et al. (1991) Genes Dev 5:141-149; Mogen et al. (1990) Plant Cell 2:1261-1272; Munroe et al. (1990) Gene 91:151-158; Ballas et al. (1989) Nucl Acids Res 17:7891-7903; and Joshi et al. (1987) Nucl Acid Res 15:9627-9639. Polyadenylation molecules from a *Pisum sativum* RbcS2 gene (Ps.RbcS2-E9; Coruzzi et al. (1984) EMBO J 3:1671-1679), AGRtu.nos (Genbank Accession E01312), E6 (Accession #U30508), rice glutelin (Okita et al. (1989) J Biol Chem 264:12573), and TaHsp17 (wheat low molecular weight heat shock protein gene; GenBank Accession #X13431) are also available.

An expression cassette may additionally contain 5' leader sequences. Such leader sequences can act to enhance translation. Translation leaders are known in the art and include: picornavirus leaders, for example, EMCV leader (encephalomyocarditis 5' noncoding region) (Elroy-Stein et al. (1989) PNAS 86:6126 6130); potyvirus leaders, for example, TEV leader (tobacco etch virus) (Gallie et al. (1995) Gene 165: 233-238, and human immunoglobulin heavy chain binding protein (BiP) (Macejak et al. (1991) Nature 353:90 94); untranslated leader from the coat protein mRNA of alfalfa mosaic virus (AMV RNA 4) (Jobling et al. (1987) Nature 325:622 625); tobacco mosaic virus leader (TMV) (Gallie et al. (1989) in Molecular Biology of RNA, ed. Cech (Liss, New York), pp. 237-256); and maize chlorotic mottle virus leader (MCMV) (Lommel et al. (1991) Virology 81:382 385). See also, Della Cioppa et al. (1987) Plant Physiol 84:965 968.

The construct may, or may not, include a sequence encoding a selectable marker. In some aspects, the selectable marker gene facilitates the selection of transformed cells or tissues. Selectable marker sequences include sequences encoding antibiotic resistance, such as neomycin phosphotransferase II (NEO) and hygromycin phosphotransferase (HPT), as well as sequences conferring resistance to herbicidal compounds, such as glufosinate ammonium, bromoxynil, imidazolinones, and 2,4-dichlorophenoxyacetate (2,4-D). Additional examples of suitable selectable marker sequences include, but are not limited to, sequences encoding resistance to chloramphenicol, methotrexate, streptomycin, spectinomycin, bleomycin, sulfonamide, bromoxynil, phosphinothricin, and glyphosate (see for example US20030083480 and US20040082770, the entire disclosures of which are herein incorporated by reference).

In some examples, a construct may include a sequence encoding a recombinase and/or its corresponding recombination sites. In some examples, the recombinase is flanked by the two or more recombination sites and the recombination sites are in the same parallel orientation. Parallel orientation means that the two or more recombination sequences are either both or all in the 3' to 5' orientation, or are both or all in the 5' to 3' orientation. A set of recombination sites arranged in the same orientation, as described herein, will result in excision, rather than inversion, of the intervening DNA sequence between the recombination sites. Inversion occurs when the recombination sites are oriented in opposite or mixed orientations.

A recombinase, also referred to as a site-specific recombinase, is a polypeptide that catalyzes conservative site-specific recombination between its compatible recombination sites. A recombinase can include native polypeptides, variants and/or fragments that retain recombinase activity. A sequence encoding a recombinase can include native polynucleotides, variants and/or fragments that encode a recombinase that retains recombinase activity. Suitable recombinases that are encoded include native recombinases or biologically active fragments or variants of the recombinase, such as those which catalyze conservative site-specific recombination between specified recombination sites. A native polypeptide or polynucleotide comprises a naturally occurring amino acid sequence or nucleotide sequence. The recombinase and its compatible sites may be referred to as a recombinase system. Any recombinase system can be used. In some examples recombinases from the integrase and resolvase families are used.

In some examples, a chimeric recombinase can be used. A chimeric recombinase is a recombinant fusion protein which is capable of catalyzing site-specific recombination between recombination sites that originate from different recombination systems. For example, if the set of recombination sites comprises a FRT site and a LoxP site, a chimeric FLP/Cre recombinase or active variant or fragment thereof can be used, or both recombinases may be separately provided. Methods for the production and use of such chimeric recombinases or active variants or fragments thereof are described, for example, in WO99/25840, the entire disclosure of which is herein incorporated by reference.

Any suitable recombination site or set of recombination sites can be used in the methods and compositions, including, but not limited to: a FRT site, a functional variant of a FRT site, a LOX site, and functional variant of a LOX site, any combination thereof, or any other combination of recombination sites known. Recombinase systems include without limitation, the Gin recombinase of phage Mu, the Pin recombinase of *E. coli*, the PinB, PinD and PinF from *Shigella*, and the R/RS system of *Zygosaccharomyces rouxii*.

Functional variants include chimeric recombination sites, such as a FRT site fused to a LOX site. For example, recombination sites from the Cre/Lox site-specific recombination system can be used. Such recombination sites include, for example, native LOX sites and various functional variants of LOX (see, e.g., U.S. Pat. No. 6,465,254 and WO01/111058, the entire disclosures of which are herein incorporated by reference). Recombinogenic modified FRT recombination sites can be used in various in vitro and in vivo site-specific recombination methods that allow for the targeted integration, exchange, modification, alteration, excision, inversion, and/or expression of a nucleotide sequence of interest, see for example, WO99/25821, WO99/25854, WO99/25840, WO99/25855, WO99/25853, and WO2007/011733, the entire disclosures of which are herein incorporated by reference.

In some examples, a construct may include one or more cell proliferation factors. In some examples, a cell proliferation factor is from the AP2/ERF family of proteins. The AP2/ERF family of proteins is a plant-specific class of putative transcription factors that regulate a wide-variety of developmental processes and are characterized by the presence of an AP2/ERF DNA binding domain. The AP2/ERF proteins have been subdivided into distinct subfamilies based on the presence of conserved domains. Initially, the family was divided into two subfamilies based on the number of DNA binding domains, with the ERF subfamily having one DNA binding domain, and the AP2 subfamily having two DNA binding domains. As more sequences were identified, the family was subsequently subdivided into five subfamilies: AP2, DREB, ERF, RAV, and others. Members of the APETALA2 (AP2) family of proteins function in a variety of biological events including, but not limited to, development, plant regeneration, cell division, embryogenesis, and cell proliferation. The AP2 family includes but is not limited to: AP2, ANT, Glossy15, AtBBM, BnBBM, and ODP2 (BBM) from maize.

A construct may comprise one or more sequence of interest. In some examples, the sequence of interest confers a trait to the transformed cell or plant. In some examples, a sequence of interest confers insect resistance. Insect resistance genes may encode resistance to pests such as rootworm, cutworm, European corn borer, soybean looper, soybean cyst nematode, aphids, and the like. Examples include polynucleotides encoding *Bacillus thuringiensis* delta-endotoxins, such as Cry proteins, see for example U.S. Pat. Nos. 5,188,960; 5,366,892; 5,593,881; 5,689,052; 5,723,756; 5,736,514; 5,747,450; 5,880,275; 5,986,177; 6,023,013; 6,033,874; 6,060,594; 6,063,597; 6,077,824; 6,083,499; 6,127,180; 6,218,188; 6,326,351; 6,399,330; 6,340,593; 6,548,291; 6,620,988; 6,624,145; 6,642,030; 6,248,535; 6,713,259; 6,893,826; 6,949,626; 7,064,249; 7,105,332; 7,179,965; 7,208,474; 7,227,056; 7,288,643; 7,323,556; 7,329,736; 7,378,499; 7,385,107; 7,476,781; 7,449,552; 7,462,760; 7,468,278; 7,504,229; 7,510,878; 7,521,235; 7,544,862; 7,605,304; 7,696,412; 7,629,504; 7,705,216; 7,772,465; 7,790,846; 7,803,943; 7,858,849; WO1991/14778; WO1999/31248; WO2001/12731; WO1999/24581; WO1997/40162; US20060112447; US20060191034; US20120278954; US20110064710; and WO2012/139004, the entire disclosures of which are herein incorporated by reference. Other examples of delta-endotoxins also include but are not limited to a DIG-3 or DIG-11 toxin (N-terminal deletion of α-helix 1 and/or α-helix 2 variants of Cry proteins such as Cry1A) of U.S. Pat. Nos. 8,304,604 and 8,304,605 the entire disclosures of which are herein incorporated by reference; Cry1A/F chimeras of U.S. Pat. Nos. 7,070,982; 6,962,705 and 6,713,063 the entire disclosures of which are herein incorporated by reference; a Cry3A protein including but not limited to an engineered hybrid insecticidal protein (eHIP) created by fusing unique combinations of variable regions and conserved blocks of at least two different Cry proteins (US20100017914 the entire disclosure of which is herein incorporated by reference); TIC807 of US20080295207 the entire disclosure of which is herein incorporated by reference; ET29, ET37, TIC809, TIC810, TIC812, TIC127, TIC128 of PCT/US2006/033867 the entire disclosure of which is herein incorporated by reference; AXMI proteins such as those in U.S. Pat. Nos. 8,236,757, 7,923,602, 8,084,416, 8,334,431, 8,318,900; WO2006/083891; WO2005/038032; WO2005/021585; US20040250311; US20040216186; US20040210965; US20040210964; US20040197917; US20040197916; WO2006/119457; WO2004/074462; US20110023184; US20110263488; US20100197592; WO2011/103248; WO2011/103247; US20100298211; US20090144852; US20100005543 the entire disclosure of which is herein incorporated by reference; and Cry proteins such as Cry1A and Cry3A having modified proteolytic sites of U.S. Pat. No. 8,319,019 the entire disclosure of which is herein incorporated by reference. More than one pesticidal protein well known to one skilled in the art can each also be expressed in plants such as Vip3Ab & Cry1Fa (US20120317682, herein incorporated by reference); Cry1BE & Cry1F (US20120311746, herein incorporated by reference); Cry1CA and Cry1AB (US20120311745, herein incorporated by reference); Cry1F and CryCa (US20120317681 herein incorporated by reference); Cry1DA and Cry1BE (US20120331590 herein incorporated by reference); Cry1DA and Cry1Fa (US20120331589 herein incorporated by reference); Cry1AB and Cry1BE (US20120324606 herein incorporated by reference); and Cry1Fa, Cry2Aa, Cry1I or Cry1E (US20120324605 herein incorporated by reference). Pesticidal proteins also include insecticidal lipases including lipid acyl hydrolases of U.S. Pat. No. 7,491,869 the entire disclosure of which is herein incorporated by reference. Pesticidal proteins also include VIP (vegetative insecticidal proteins) toxins of U.S. Pat. Nos. 5,877,012, 6,107,279, 6,137,033, 7,244,820, 7,615,686, and 8,237,020 the entire disclosures of which are herein incorporated by reference, and the like. Other VIP proteins are well known to one skilled in the art. Pesticidal proteins also include toxin complex (TC) proteins, obtainable from organisms such as *Xenorhabdus, Photorhabdus* and *Paenibacillus* (see, U.S. Pat. Nos. 7,491,698 and 8,084,418 the entire disclosures of which are herein incorporated by reference).

Polynucleotides encoding antifungal proteins are also useful (e.g., U.S. Pat. Nos. 6,875,907, 7,498,413, 7,589,176, 7,598,346, 8,084,671, 6,891,085 and 7,306,946; herein incorporated by reference). Polynucleotides encoding LysM receptor-like kinases for the perception of chitin fragments as a first step in plant defense response against fungal pathogens (US20120110696 herein incorporated by reference) are also of use. Other suitable polynucleotides include those encoding a hydrophobic moment peptide, such as those described in WO1995/16776 and U.S. Pat. No. 5,580,852 (each is herein incorporated by reference), peptide derivatives of tachyplesin which inhibit fungal plant pathogens, and WO1995/18855 and U.S. Pat. No. 5,607,914 herein incorporated by reference (synthetic antimicrobial peptides that confer disease resistance). Other suitable polynucleotides include those encoding detoxification peptides such as for fumonisin, beauvericin, moniliformin and zearalenone and their structurally related derivatives. For example, see, U.S. Pat. Nos. 5,716,820; 5,792,931; 5,798,255; 5,846,812; 6,083,736; 6,538,177; 6,388,171 and 6,812,380 the entire disclosures of which are herein incorporated by reference, and avirulence (avr) and disease resistance (R) genes (Jones et al. (1994) Science 266:789; Martin et al. (1993) Science 262:1432; and Mindrinos et al. (1994) Cell 78:1089); and the like.

In other examples, the sequence(s) of interest may alter the composition of a plant, plant tissue, plant part, or seed. In some examples, these include modifying the fatty acid content or profile, altering the amino acid content or profile, altering the carbohydrate content or profile, altering the fiber content or profile, and/or altering the digestibility or processability of a plant or part thereof, and the like. Examples of a sequence of interest include but are not limited to genes affecting starch production (U.S. Pat. Nos. 6,538,181; 6,538, 179; 6,538,178; 5,750,876; 6,476,295), modified oil production (U.S. Pat. Nos. 6,444,876; 6,426,447; 6,380,462), high oil production (U.S. Pat. Nos. 6,495,739; 5,608,149; 6,483,008; 6,476,295), modified fatty acid content (U.S. Pat. Nos. 6,828,475; 6,822,141; 6,770,465; 6,706,950; 6,660,849; 6,596,538; 6,589,767; 6,537,750; 6,489,461; 6,459,018), high protein production (U.S. Pat. No. 6,380,466), fruit ripening (U.S. Pat. No. 5,512,466), enhanced animal and human nutrition (U.S. Pat. Nos. 6,723,837; 6,653,530; 6,5412,59; 5,985,605; 6,171,640), biopolymers (U.S. Pat. RE37,543; U.S. Pat. Nos. 6,228,623; 5,958,745 and US20030028917), improved processing traits (U.S. Pat. No. 6,476,295), improved digestibility (U.S. Pat. No. 6,531,648) low raffinose (U.S. Pat. No. 6,166,292), industrial enzyme production (U.S. Pat. No. 5,543,576), improved flavor (U.S. Pat. No. 6,011,199), nitrogen fixation (U.S. Pat. No. 5,229,114), hybrid seed production (U.S. Pat. No. 5,689,041), fiber production (U.S. Pat. Nos. 6,576,818; 6,271,443; 5,981,834; 5,869,720) and biofuel production (U.S. Pat. No. 5,998,700), the disclosures of each are herein incorporated by reference.

For example, down-regulation of stearoyl-ACP can increase stearic acid content of the plant. See, WO1999/64579 the entire disclosure of which is herein incorporated by reference; elevating oleic acid via FAD-2 gene modification and/or decreasing linolenic acid via FAD-3 gene modification (see, U.S. Pat. Nos. 6,063,947; 6,323,392; 6,372,965 and WO1993/11245 the entire disclosures of which are herein incorporated by reference); altering conjugated linolenic or linoleic acid content, such as in WO2001/12800 the entire disclosures of each are herein incorporated by reference; altering LEC1, AGP, Dek1, Superal1, milps, various Ipa genes such as Ipa1, Ipa3, hpt or hggt. For example, see, WO2002/42424, WO1998/22604, WO2003/011015, WO2002/057439, U.S. Pat. Nos. 6,423,886, 6,197,561, 6,825,397, US20030079247, and US20030204870 the entire disclosures of which are herein incorporated by reference; polynucleotides encoding delta-8 desaturase for making long-chain polyunsaturated fatty acids (U.S. Pat. Nos. 8,058,571 and 8,338,152 the entire disclosures of which are herein incorporated by reference) and delta-9 desaturase for lowering saturated fats (U.S. Pat. No. 8,063,269 the entire disclosure of which is herein incorporated by reference); polynucleotides and encoded proteins associated with lipid and sugar metabolism regulation, in particular, lipid metabolism protein (LMP) used in methods of producing transgenic plants and modulating levels of seed storage compounds including lipids, fatty acids, starches or seed storage proteins and use in methods of modulating the seed size, seed number, seed weights, root length and leaf size of plants (EP 2404499 the entire disclosure of which is herein incorporated by reference); altering expression of a High-Level Expression of Sugar-Inducible 2 (HSI2) protein in the plant to increase or decrease expression of HSI2 in the plant. Increasing expression of HSI2 increases oil content while decreasing expression of HSI2 decreases abscisic acid sensitivity and/or increases drought resistance (US20120066794 the entire disclosure of which is herein incorporated by reference); expression of cytochrome b5 (Cb5) alone or with FAD2 to modulate oil content in plant seed, particularly to increase the levels of omega-3 fatty acids and improve the ratio of omega-6 to omega-3 fatty acids (US20110191904 the entire disclosure of which is herein incorporated by reference); and polynucleotides encoding wrinkled1-like polypeptides for modulating sugar metabolism (U.S. Pat. No. 8,217,223 the entire disclosure of which is herein incorporated by reference). Fatty acid modification genes may also be used to affect starch content and/or composition through the interrelationship of the starch and oil pathways; altered antioxidant content or composition, such as alteration of tocopherol or tocotrienols. For example, see, U.S. Pat. No. 6,787,683, US20040034886, and WO2000/68393 the entire disclosures of which are herein incorporated by reference, involving the manipulation of antioxidant levels, and through alteration of a homogentisate geranyl geranyl transferase (hggt) (WO2003/082899); and altered essential seed amino acids. For example, see, U.S. Pat. No. 6,127,600 the entire disclosure of which is herein incorporated by reference (method of increasing accumulation of essential amino acids in seeds), U.S. Pat. No. 6,080,913 the entire disclosure of which is herein incorporated by reference (binary methods of increasing accumulation of essential amino acids in seeds), U.S. Pat. No. 5,990,389 the entire disclosure of which is herein incorporated by reference (high lysine), WO1999/40209 the entire disclosure of which is herein incorporated by reference (alteration of amino acid compositions in seeds), WO1999/29882 the entire disclosure of which is herein incorporated by reference (methods for altering amino acid content of proteins), U.S. Pat. No. 5,850,016 the entire disclosure of which is herein incorporated by reference (alteration of amino acid compositions in seeds), WO1998/20133 the entire disclosure of which is herein incorporated by reference (proteins with enhanced levels of essential amino acids), U.S. Pat. No. 5,885,802 the entire disclosure of which is herein incorporated by reference (high methionine), U.S. Pat. No. 5,885,801 the entire disclosure of which is herein incorporated by reference (high threonine), U.S. Pat. No. 6,664,445 the entire disclosure of which is herein incorporated by reference (plant amino acid biosynthetic enzymes), U.S. Pat. No. 6,459,019 the entire disclosure of which is herein incorporated by reference (increased lysine and threonine), U.S. Pat. No. 6,441,274 the entire disclosure of which is herein incorporated by reference (plant tryptophan synthase beta subunit), U.S. Pat. No. 6,346,403 the entire disclosure of which is herein incorporated by reference (methionine metabolic enzymes), U.S. Pat. No. 5,939,599 the entire disclosure of which is herein incorporated by reference (high sulfur), U.S. Pat. No. 5,912,414 the entire disclosure of which is herein incorporated by reference (increased methionine), WO1998/56935 the entire disclosure of which is herein incorporated by reference (plant amino acid biosynthetic enzymes), WO1998/45458 the entire disclosure of which is herein incorporated by reference (engineered seed protein having higher percentage of essential amino acids), WO1998/42831 the entire disclosure of which is herein incorporated by reference (increased lysine), U.S. Pat. No. 5,633,436 the entire disclosure of which is herein incorporated by reference (increasing sulfur amino acid content), U.S. Pat. No. 5,559,223 the entire disclosure of which is herein incorporated by reference (synthetic storage proteins), WO1996/01905 the entire disclosure of which is herein incorporated by reference (increased threonine), WO1995/15392 the entire disclosure of which is herein incorporated by reference (increased lysine), US20030163838, US20030150014, US20040068767, U.S. Pat. No. 6,803,498, and WO2001/79516 the entire disclosures of which are herein incorporated by reference. Polynucleotides that confer plant digestibility are also useful. For example, altering the level of xylan present in the cell wall of a plant can be achieved by modulating expression of xylan synthase (See, e.g., U.S. Pat. No. 8,173,866 the entire disclosure of which is herein incorporated by reference).

In some examples, the sequence(s) of interest include polynucleotides that control male-sterility, including but not limited to those as disclosed in U.S. Pat. Nos. 4,654,465 and 4,727,219 the entire disclosures of which are herein incorporated by reference and U.S. Pat. Nos. 3,861,709 and 3,710,511 the entire disclosures of which are herein incorporated by reference. In addition to these, U.S. Pat. No. 5,432,068 the entire disclosure of which is herein incorporated by reference, describes a system of nuclear male sterility. For additional examples of nuclear male and female sterility systems and genes, see also U.S. Pat. Nos. 5,859,341; 6,297,426; 5,478,369; 5,824,524; 5,850,014; and 6,265,640, all of which are hereby incorporated by reference in their entireties.

In some examples, the sequence(s) of interest that are useful in the aspects include polynucleotides that affect abiotic stress resistance including but not limited to flowering, ear and seed development, enhancement of nitrogen utilization efficiency, altered nitrogen responsiveness, drought resistance or tolerance, cold resistance or tolerance and salt resistance or tolerance and increased yield under stress. For example, see: WO2000/73475 the entire disclosure of which is herein incorporated by reference where water use efficiency is altered through alteration of malate; U.S. Pat. Nos. 5,892,009, 5,965,705, 5,929,305, 5,891,859, 6,417,428, 6,664,446, 6,706,866, 6,717,034, 6,801,104, WO2000/060089, WO2001/026459, WO2001/035725, WO2001/034726, WO2001/035727, WO2001/036444, WO2001/036597, WO2001/036598, WO2002/015675, WO2002/017430, WO2002/077185, WO2002/079403, WO2003/013227, WO2003/013228, WO2003/014327, WO2004/031349, WO2004/076638, WO199809521 the entire disclosures of which are herein incorporated by reference; WO199938977 describing genes, the entire disclosure of which is herein incorporated by reference, including CBF genes and transcription factors effective in mitigating the negative effects of freezing, high salinity and drought on plants, as well as conferring other positive effects on plant phenotype; US20040148654 and WO2001/36596 where abscisic acid is altered in plants resulting in improved plant phenotype such as increased yield and/or increased tolerance to abiotic stress, the entire disclosures of which are herein incorporated by reference; WO2000/006341, WO2004/090143, U.S. Pat. Nos. 7,531,723 and 6,992,237 the entire disclosures of which are herein incorporated by reference wherein cytokinin expression is modified resulting in plants with increased stress tolerance, such as drought tolerance, and/or increased yield. Also see, WO2002/02776, WO2003/052063, JP2002/281975, U.S. Pat. No. 6,084,153, WO2001/64898, U.S. Pat. No. 6,177,275 and U.S. Pat. No. 6,107,547 the entire disclosures of which are herein incorporated by reference (enhancement of nitrogen utilization and altered nitrogen responsiveness); for ethylene alteration, see, US20040128719, US20030166197 and WO2000/32761 the entire disclosures of which are herein incorporated by reference; for plant transcription factors or transcriptional regulators of abiotic stress, see, e.g., US20040098764 or US20040078852 the entire disclosures of which are herein incorporated by reference; polynucleotides that encode polypeptides that increase expression of vacuolar pyrophosphatase such as AVP1 (U.S. Pat. No. 8,058,515 the entire disclosure of which is herein incorporated by reference) for increased yield; nucleic acid encoding a HSFA4 or a HSFA5 (heat shock factor of the class A4 or A5) polypeptides, an oligopeptide transporter protein (OPT4-like) polypeptide; a plastochron2-like (PLA2-like) polypeptide or a Wuschel related homeobox 1-like (WOX1-like) polypeptide (US20110283420 the entire disclosure of which is herein incorporated by reference); down regulation of polynucleotides encoding poly (ADP-ribose) polymerase (PARP) proteins to modulate programmed cell death (U.S. Pat. No. 8,058,510 the entire disclosure of which is herein incorporated by reference) for increased vigor; polynucleotide encoding DTP21 polypeptides for conferring drought resistance (US20110277181 the entire disclosure of which is herein incorporated by reference); nucleotide sequences encoding ACC Synthase 3 (ACS3) proteins for modulating development, modulating response to stress, and modulating stress tolerance (US20100287669 the entire disclosure of which is herein incorporated by reference); polynucleotides that encode proteins that confer a drought tolerance phenotype (DTP) for conferring drought resistance (WO2012/058528 the entire disclosure of which is herein incorporated by reference); tocopherol cyclase (TC) polynucleotides for conferring drought and salt tolerance (US20120272352 the entire disclosure of which is herein incorporated by reference); polynucleotides encoding CAAX amino terminal family proteins for stress tolerance (U.S. Pat. No. 8,338,661 the entire disclosure of which is herein incorporated by reference); mutations in the SAL1 encoding polypeptides have increased stress tolerance, including increased drought resistant (US20100257633 the entire disclosure of which is herein incorporated by reference); expression of a polynucleotide encoding a polypeptide selected from the group consisting of: GRF polypeptide, RAA1-like polypeptide, SYR polypeptide, ARKL polypeptide, and YTP polypeptide increasing yield-related traits (US20110061133 the entire disclosure of which is herein incorporated by reference); modulating expression in a plant of a polynucleotide encoding a Class III Trehalose Phosphate Phosphatase (TPP) polypeptide for enhancing yield-related traits in plants, particularly increasing seed yield (US20100024067 the entire disclosure of which is herein incorporated by reference).

In some examples, the sequence(s) of interest include other polynucleotides that affect plant growth and agronomic traits such as yield, flowering, plant growth and/or plant structure, see e.g., WO1997/49811 the entire disclosure of which is herein incorporated by reference (LHY), WO1998/56918 the entire disclosure of which is herein incorporated by reference (ESD4), WO1997/10339 and U.S. Pat. No. 6,573,430 the entire disclosures of which are herein incorporated by reference (TFL), U.S. Pat. No. 6,713,663 the entire disclosure of which is herein incorporated by reference (FT), WO1996/14414 (CON), WO1996/38560, WO2001/21822 the entire disclosures of which are herein incorporated by reference (VRN1), WO2000/44918 the entire disclosure of which is herein incorporated by reference (VRN2), WO1999/49064 the entire disclosure of which is herein incorporated by reference (GI), WO2000/46358 the entire disclosure of which is herein incorporated by reference (FR1), WO1997/29123, U.S. Pat. No. 6,794,560, U.S. Pat. No. 6,307,126 the entire disclosures of which are herein incorporated by reference (GAI), WO1999/09174 the entire disclosure of which is herein incorporated by reference (D8 and Rht) and WO2004/031349 the entire disclosure of which is herein incorporated by reference (transcription factors).

In some examples, the sequence(s) of interest include polynucleotides that confer increased yield. For example, a crop plant can be transformed with a 1-AminoCyclopropane-1-Carboxylate Deaminase-like Polypeptide (ACCDP) coding nucleic acid, wherein expression in the crop plant results in the plant's increased root growth, and/or increased yield, and/or increased tolerance to environmental stress as compared to a wild type variety of the plant (U.S. Pat. No. 8,097,769 the entire disclosure of which is herein incorporated by reference); over-expression of maize zinc finger protein gene (Zm-ZFP1) using a seed preferred promoter has been shown to enhance plant growth, increase kernel number and total kernel weight per plant (US20120079623 the entire disclosure of which is herein incorporated by reference); constitutive over-expression of maize lateral organ boundaries (LOB) domain protein (Zm-LOBDP1) has been shown to increase kernel number and total kernel weight per plant (US20120079622 the entire disclosure of which is herein incorporated by reference); enhancing yield-related traits in plants by modulating expression in a plant of a nucleic acid encoding a VIM1 (Variant in Methylation 1)-like polypeptide or a VTC2-like (GDP-L-galactose phosphorylase) polypeptide or a DUF1685 polypeptide or an ARF6-like (Auxin Responsive Factor) polypeptide (WO2012/038893 the entire disclosure of which is herein incorporated by reference); modulating expression in a plant of a nucleic acid encoding a Ste20-like polypeptide or a homologue thereof gives plants having increased yield relative to control plants (EP2431472 the entire disclosure of which is herein incorporated by reference); and polynucleotides encoding nucleoside diphosphatase kinase (NDK) polypeptides and homologs thereof for modifying the plant's root architecture (US20090064373 the entire disclosure of which is herein incorporated by reference).

Herbicide resistance traits may include genes coding for resistance to herbicides that act to inhibit the action of acetolactate synthase (ALS), in particular the sulfonylurea-type herbicides (e.g., the acetolactate synthase (ALS) gene containing mutations leading to such resistance, in particular the S4 and/or HRA mutations), genes coding for resistance to herbicides that act to inhibit action of glutamine synthase, such as phosphinothricin or basta (e.g., the bar gene); glyphosate (e.g., the EPSPS gene and the gat gene; see, for example, US20040082770 and WO03/092360 the entire disclosures of which are herein incorporated by reference); or other such genes known in the art. The bar gene encodes resistance to the herbicide basta, the nptII gene encodes aminoglycoside 3'-phosphotransferase and provides resistance to the antibiotics kanamycin, neomycin geneticin and paromomycin, and the ALS-gene mutants encode resistance to the herbicide chlorsulfuron.

In one example of the present disclosure, the construct contains a selectable, screenable, or scoreable marker gene. The DNA that serves as a selection or screening device may function in a regenerable plant tissue to produce a compound that would confer upon the plant tissue resistance to an otherwise toxic compound. A number of screenable or selectable marker genes are known in the art and can be used. Examples of selectable markers and genes are provided in Miki & McHugh ((2004) J Biotechnol 107 193-232). Genes of interest for use as a selectable, screenable, or scoreable marker include but are not limited to gus, GFP (green fluorescent protein), red fluorescent protein (RFP; DsRED), yellow fluorescent protein (YFP; ZsYELLOW), cyan fluorescent protein (CFP), luciferase (LUX), genes conferring tolerance to antibiotics like kanamycin (Dekeyser et al. (1989) Plant Physiol 90:217-223), neomycin, kanamycin, paromomycin, G418, aminoglycosides, spectinomycin, streptomycin, hygromycin B, bleomycin, phleomycin, sulfonamides, streptothricin, chloramphenicol, methotrexate, 2-deoxyglucose, betaine aldehyde, S-aminoethyl L-cysteine, 4-methyltryptophan, D-xylose, D-mannose, benzyladenine-N-3-glucuronidase, genes that encode enzymes that give tolerance to herbicides like glyphosate (e.g., 5-enolpyruvyl-shikimate-3-phosphate synthase (EPSPS): Della-Cioppa et al. (1987) Bio/Technology 5:579-584; U.S. Pat. Nos. 5,627,061; 5,633,435; 6,040,497; 5,094,945; WO04074443, and WO04009761; glyphosate oxidoreductase (GOX; U.S. Pat. No. 5,463,175); glyphosate decarboxylase (WO05003362 and US20040177399); or glyphosate N-acetyltransferase (GAT; US20030083480), dalapon (e.g., dehI encoding 2,2-dichloropropionic acid dehalogenase conferring tolerance to 2,2-dichloropropionic acid (Dalapon; WO199927116), bromoxynil (haloarylnitrilase (Bxn) for conferring tolerance to bromoxynil (WO198704181; U.S. Pat. No. 4,810,648; WO198900193A)), sulfonyl herbicides (e.g., acetohydroxyacid synthase or acetolactate synthase conferring tolerance to acetolactate synthase inhibitors such as sulfonylurea, imidazolinone, triazolopyrimidine, pyrimidyloxybenzoates and phthalide; (U.S. Pat. Nos. 6,225,105; 5,767,366; 4,761,373; 5,633,437; 6,613,963; 5,013,659; 5,141,870; 5,378,824; and 5,605,011)); encoding ALS, GST-II), bialaphos or phosphinothricin or derivatives (e.g., phosphinothricin acetyltransferase (bar) conferring tolerance to phosphinothricin or glufosinate (U.S. Pat. Nos. 5,646,024; 5,561,236; 5,276,268; 5,637,489; and 5,273,894; and EP275,957); atrazine (encoding GST-III), dicamba (dicamba monooxygenase (DMO; US20030115626, US20030135879), and sethoxydim (modified acetyl-coenzyme A carboxylase for conferring tolerance to cyclohexanedione (sethoxydim) and aryloxyphenoxypropionate (haloxyfop) (U.S. Pat. No. 6,414,222), among others. Other selection procedures can also be implemented including positive selection mechanisms, such as use of the manA gene of *E. coli*, allowing growth in the presence of mannose (see also Miki & McHugh (2004) J Biotechnol 107 193-232).

The sequence(s) of interest also include a polynucleotide that encodes a polyribonucleotide to silence or reduce expression of a target sequence via gene silencing technologies such as cosuppression, antisense, RNAi, expression of miRNAs (natural or engineered), expression of trans-acting siRNAs, and expression of ribozymes (see e.g., US20060200878). The polyribonucleotide may comprise a promoter hairpin, a microRNA or a non-coding RNA. A promoter hairpin can include a double-stranded ribonucleotide structure such as a stem-loop structure or an inverted-repeated sequence that may be involved in RNA interference (RNAi) or small interfering RNA (siRNA). Examples of hairpin promoters are described in, for example, in US20070199100, the entire disclosure of which is herein incorporated by reference.

Any mRNA produced by a DNA construct may also contain a 5' non-translated leader sequence. This sequence can be derived from the promoter selected to express the gene and can be specifically modified so as to increase or decrease translation of the mRNA. The 5' non-translated regions can also be obtained from viral RNAs, from suitable eukaryotic genes, or from a synthetic gene sequence. Enhancer sequences may be used to increase or alter the translational efficiency of the resultant mRNA. The non-translated leader sequence can be derived from the instant promoter/regulatory region, or optionally from any unrelated promoters or genes (see, e.g., U.S. Pat. No. 5,362,865). Examples of leader sequences include maize and *petunia* heat shock protein leaders (U.S. Pat. No. 5,362,865), plant virus coat protein leaders, plant rubisco leaders, GmHsp (U.S. Pat. No. 5,659,122), PhDnaK (U.S. Pat. No. 5,362, 865), AtAnt1, TEV (Carrington & Freed (1990) J Virol 64:1590-1597), OsActl (U.S. Pat. No. 5,641,876), OsTPI (U.S. Pat. No. 7,132,528), OsAct15 (US20060162010), and AGRtu.nos (GenBank Accession V00087; Bevan et al. (1983) Nature, 304:184-187). Other genetic components that serve to enhance expression or affect transcription or translation of a gene are also envisioned as genetic components. For example, intron sequences have been shown to aid in the expression of transgenes in plant cells. Examples of introns include the actin intron (U.S. Pat. No. 5,641,876), the corn HSP70 intron (ZmHSP70; U.S. Pat. No. 5,859,347; U.S. Pat. No. 5,424,412), and rice TPI intron (OsTPI; U.S. Pat. No. 7,132,528).

For *Ochrobactrum*-mediated transformation, the construct is typically introduced into a suitable host such as *E. coli* and mated into another suitable host such as *Ochrobactrum*. Alternatively, the construct is directly transformed (e.g., by electroporation) into competent *Ochrobactrum*. The construct may be on a Ti or Ri plasmid, or may be provided separately. The Ti or Ri plasmid may be a naturally occurring plasmid, such as from *Agrobacterium*, and may induce tumors or hairy roots, respectively (see, e.g., Hooykaas et al. (1977) J Gen Microbiol 98:477-484, and Weller et al. (2004) Appl Env Microbiol 70:2779-2785). In other examples, a Ti or Ri plasmid may alternatively be disarmed and unable to cause plant cell proliferation. Since *Ochrobactrum* and *Agrobacterium* have differing infection mechanisms, plant cell contact with *Ochrobactrum* may increase the frequency of germline transformation, and/or have less deleterious effects on the target cell or plant during transformation once the Ti or Ri helper plasmid is introduced.

Compositions and methods using *Ochrobactrum* to introduce one or more genetic components into cells, tissues, and/or plants are provided. In some examples, the hosts contain disarmed Ti or Ri plasmids that do not contain the oncogenes that cause tumorigenesis or rhizogenesis, derivatives of which are used as the vectors and contain the genes of interest that are subsequently introduced into plants. In another aspect, the *Ochrobactrum* transfer DNA into plant cells by means of a T4SS independent mechanism, namely oriT-mediated conjugal transfer. Functions needed for T4SS-independent DNA transfer may reside on the plasmid containing the DNA to be transferred, or may reside on the chromosome or another plasmid, including a Ti or Ri plasmid, also present in such a bacterial cell.

Any suitable plant culture medium can be used to develop or maintain a plant tissue culture, supplemented as appropriate with additional plant growth regulators including but not limited to auxins such as picloram (4-amino-3,5,6-trichloropicolinic acid), 2,4-D (2,4-dichlorophenoxyacetic acid) and dicamba (3,6-dichloroanisic acid); cytokinins such as BAP (6-benzylaminopurine) and kinetin; ABA; and gibberellins. Other media additives can include but are not limited to amino acids, macro elements, iron, microelements, inositol, vitamins and organics, carbohydrates, undefined media components such as casein hydrolysates, with or without an appropriate gelling agent such as a form of agar, such as a low melting point agarose or phytagel. A variety of tissue culture media are well known in the art, which when supplemented appropriately, support plant tissue growth and development and are suitable for plant transformation and regeneration. Examples of such media include but are not limited to Murashige & Skoog ((1962) Physiol Plant 15:473-497), N6 (Chu et al. (1975) Scientia Sinica 18:659), Linsmaier & Skoog ((1965) Physiol Plant 18:100), Uchimiya & Murashige ((1962) Plant Physiol 15:473), Gamborg's media (Gamborg et al. (1968) Exp Cell Res 50:151), D medium (Duncan et al. (1985) Planta 165:322-332), McCown's Woody plant media (McCown & Lloyd (1981) Planta 165:322-332), Nitsch & Nitsch ((1969) Science 163:85-87), and, Schenk & Hildebrandt (1972 Can J Bot 50:199-204) or derivations of these media supplemented accordingly. As well known in the art, media and media supplements such as nutrients and growth regulators for use in transformation and regeneration, as well as other culture conditions such as light intensity during incubation, pH, and incubation temperatures can be modified or optimized for the particular cell, tissue, and/or plant of interest.

Those of skill in the art are aware of the typical steps in the plant transformation process. The *Ochrobactrum* to be used can be prepared either by inoculating a liquid medium directly from a glycerol stock or by streaking the bacteria onto a solidified media from a glycerol stock, allowing the bacteria to grow under the appropriate selective conditions. The *Ochrobactrum* may be pre-induced by growth under nutritional or cultural conditions including the presence of acetosyringone in an amount that facilitates transformation. Those of skill in the art are familiar with procedures for growth and suitable culture conditions for bacteria as well as subsequent inoculation procedures. The density of the bacterial culture used for inoculation and the ratio of the number of bacterial cells to amount of explant tissue can vary from one system to the next, and therefore optimization of these parameters for any transformation method is expected.

The next stage of the transformation process is the inoculation. In this stage the suitably prepared plants, plant tissues, or explants, and the bacterial cell suspension are mixed together. The duration and condition of the inoculation and bacterial cell density will vary depending on the plant transformation system. Growth or inoculation of transforming bacteria may occur in the presence of acetosyringone, or other known inducer of expression of the virulence genes located on Ti or Ri plasmids.

After inoculation any excess bacterial suspension can be removed and the bacteria and target plant material are co-cultured. The co-culture refers to the time post-inoculation and prior to transfer to an optional delay or selection medium. Any number of plant tissue culture media can be used for the co-culture step. Plant tissues after inoculation with bacteria may be cultured in a liquid or a semi-solid media. Co-culturing is typically performed for about one to four days.

After co-culture with bacteria, the inoculated plant tissues or explants can optionally be placed directly onto selective media. Alternatively, after co-culture with bacteria, they could be placed on media without the selective agent and subsequently placed onto selective media. Those of skill in the art are aware of the numerous modifications in selective regimes, media, and growth conditions that can be varied depending on the plant system and the selective agent. Typical selective agents include but are not limited to antibiotics such as geneticin (G418), kanamycin, or paromomycin, or the herbicides glyphosate, glufosinate, or dicamba. Additional appropriate media components can be added to the selection or delay medium to inhibit bacterial growth. Such media components can include, but are not limited to, antibiotics such as carbenicillin or cefotaxime.

The cultures are subsequently transferred to a medium suitable for the recovery of transformed plantlets. Those of skill in the art are aware of the number of methods to recover transformed plants. A variety of media and transfer requirements can be implemented and optimized for each plant system for plant transformation and recovery of transgenic plants. Consequently, such media and culture conditions disclosed or provided herein can be modified or substituted with nutritionally equivalent components, or similar processes for selection and recovery of transgenic events, and still fall within the scope of the present disclosure.

The transformants produced, and their progeny, may subsequently be analyzed to determine the presence or absence of a particular sequence of interest contained on the transformation vector, or a molecular phenotype produced by delivery of a sequence of interest. Molecular analyses can include but are not limited to Southern blots, PCR (polymerase chain reaction) analyses, nucleic acid sequencing, analysis of enzymatic activities, immunodiagnostic approaches, analysis of protein expression, expression profile analyses, metabolic analyses and/or profiles, phenotyping, field evaluations and the like. These and other well-known methods can be performed to confirm the genotype, phenotype, and/or stability of cells, tissues, plants, seeds and the like produced by the methods disclosed.

The term plant includes whole plants, plant organs (e.g., leaves, stems, fruits, roots, etc.), seeds, plant cells, protoplasts, tissues, callus, embryos, as well as, flowers, stems, fruits, leaves, roots, and progeny. A transgenic plant is a plant currently or previously transformed with a nucleic acid, and therefore consisting at least in part of transgenic cells. A plant part includes plant cells, plant protoplasts, plant cell tissue cultures from which plants can be regenerated, plant calli, plant clumps, and plant cells that are intact in plants or parts of plants such as embryos, pollen, ovules, seeds, leaves, flowers, branches, fruit, kernels, ears, cobs, husks, stalks, roots, root tips, anthers, and the like. A plant cell includes, without limitation, protoplasts and cells of seeds, suspension cultures, embryos, meristematic regions, callus tissue, leaves, roots, shoots, gametophytes, sporophytes, pollen, and microspores. Green tissue refers to those plant parts that, when grown under conditions that include a period of light, contain chlorophyll and photosynthesize. Green tissue can include regenerative tissue, callus tissue, and in vitro-cultured tissue, such as containing multiple-shoot meristem-like structures. These tissues have a high percentage of cells capable of sustained cell division and are competent for regeneration over long periods.

The methods and compositions may be suitable for any plant, including, but not limited to, monocots and dicots. Plants of interest include grain plants that provide seeds of interest, oil-seed plants, and leguminous plants. Examples of plant species of interest include, but are not limited to beans, canola, corn (*Zea mays*), *Brassica* sp. (e.g., *B. napus, B. rapa, B. juncea*), particularly those *Brassica* species useful as sources of seed oil, alfalfa (*Medicago sativa*), rice (*Oryza sativa*), rye (*Secale cereale*), sorghum (*Sorghum bicolor, Sorghum vulgare*), millet (e.g., pearl millet (*Pennisetum glaucum*), proso millet (*Panicum miliaceum*), foxtail millet (*Setaria italica*), finger millet (*Eleusine coracana*)), sunflower (*Helianthus annuus*), safflower (*Carthamus tinctorius*), wheat (*Triticum aestivum*), soybean (*Glycine max, Glycine soja*), tobacco (*Nicotiana tabacum*), potato (*Solanum tuberosum*), peanuts (*Arachis hypogaea*), cotton (*Gossypium barbadense, Gossypium hirsutum*), sweet potato (*Ipomoea batatus*), cassava (*Manihot esculenta*), coffee (*Coffea* spp.), coconut (*Cocos nucifera*), pineapple (*Ananas comosus*), citrus trees (*Citrus* spp.), cocoa (*Theobroma cacao*), tea (*Camellia sinensis*), banana (*Musa* spp.), avocado (*Persea americana*), fig (*Ficus casica*), guava (*Psidium guajava*), mango (*Mangifera indica*), olive (*Olea europaea*), papaya (*Carica papaya*), cashew (*Anacardium occidentale*), macadamia (*Macadamia integrifolia*), almond (*Prunus amygdalus*), sugar beets (*Beta vulgaris*), sugarcane (*Saccharum* spp.), oats, barley, vegetables, ornamentals, and conifers.

Vegetables include tomatoes (*Lycopersicon esculentum*), broccoli, cabbage, carrot, cauliflower, celery, eggplant, fennel, garden beans, radish, gourd, leek, Chinese cabbage, okra, onion, pea, pepper, pumpkin, spinach, squash, sweet corn, lettuce (e.g., *Lactuca sativa*), green beans (*Phaseolus vulgaris*), lima beans (*Phaseolus limensis*), peas (*Lathyrus* spp.), and members of the genus *Cucumis* such as cucumber (*C. sativus*), melons, watermelon, cantaloupe (*C. cantalupensis*), and musk melon (*C. melo*). Ornamentals include azalea (*Rhododendron* spp.), hydrangea (*Macrophylla hydrangea*), hibiscus (*Hibiscus rosasanensis*), roses (*Rosa* spp.), tulips (*Tulipa* spp.), daffodils (*Narcissus* spp.), petunias (*Petunia hybrida*), carnation (*Dianthus caryophyllus*), poinsettia (*Euphorbia pulcherrima*), and chrysanthemum.

Conifers that may be used include, for example, pines such as loblolly pine (*Pinus taeda*), slash pine (*Pinus elliotii*), ponderosa pine (*Pinus ponderosa*), lodgepole pine (*Pinus contorta*), and Monterey pine (*Pinus radiata*); Douglas-fir (*Pseudotsuga menziesii*); Western hemlock (*Tsuga canadensis*); Sitka spruce (*Picea glauca*); redwood (*Sequoia sempervirens*); true firs such as silver fir (*Abies amabilis*) and balsam fir (*Abies balsamea*); and cedars such as Western red cedar (*Thuja plicata*) and Alaska yellow-cedar (*Chamaecyparis nootkatensis*).

EXAMPLES

Those of skill in the art will appreciate the many advantages of the methods and compositions provided herein. The following examples provide detail specific studies, methods and compositions, however, those of skill in the art will appreciate that many changes can be made in the specific examples disclosed and still obtain a like or similar result without departing from the spirit and scope of the disclosure. All references cited herein are incorporated herein by reference in their entirety to the extent that they supplement, explain, provide a background for, or teach methodology, techniques, or compositions employed herein.

Example 1—Plasmid Construction

The plasmid pVir8 (PHP70365; SEQ ID NO: 106) is a 38.8 kb vector with vir genes and a T-DNA that was constructed in *E. coli* using standard molecular biology methods. It has two origins (ColE1, pVS1) for stable replication in a broad range of bacteria, and encodes resistance to the antibiotic gentamicin. It contains ~27 kb of vir genes from the hypervirulent pTiBo542 Ti plasmid and a T-DNA encoding a selectable bar (herbicide bialaphos resistance gene) marker and a visual red fluorescent protein marker for plants. Copies of the vir genes were isolated from the pTiBo542 Ti plasmid (Genbank accession number DQ058764 and NC_010929) contained in *Agrobacterium tumefaciens* strain AGL1 (Lazo et al. (1991) Biotechnology 10:963-967) using PCR. Vir genes included: virA, virJ, virB1-B11, virG, virC1-C2, virD1-D5 and virE1-E3. An IS66 insertion sequence between virA and virJ and a region between virJ and virB1 were each deleted to enhance stability and reduce size.

Further improvements may be possible using functional variants or derivatives of these vir genes as well. Overlapping PCR products were isolated and assembled. A 1.2 kb pBR322 ColEI origin of replication (Bolivar et al. (1977) Gene 2:95-113) was included for replication in *E. coli*. A version of the broad host range pVS1 origin of replication (Heeb et al. (2000) Molecular Plant-Microbe Interactions 13:232-237) was included for stable replication in a variety of bacterial hosts. An aacC1 gene encoding a gentamicin acetyl transferase from Tn1696 was included for gentamycin resistance (Poteete et al. (2006) BioTechniques 41:261-264). Plasmid RV013684 (SEQ ID 113) is a destination vector, which serves as a construction intermediate for altering the T-DNA composition using the Gateway™ and MultiSite Gateway® recombination cloning technology (Thermo Fisher Scientific Inc.). This plasmid has the Gateway™

ATTR4 and ATTR3 recombinase sites inside the right and left borders of the T-DNA. This allows one to readily replace the T-DNA region with other T-DNA's constructed in an entry-type vector containing flanking ATTL4 and ATTL3 sites.

Several series of additional plasmids were similarly constructed in an effort to optimize the transformation vector system These included separating the vir genes and the T-DNA's into separate helper and binary plasmids, respectively to form "co-habitating" systems. "Co-integrated" designs similar to PHP70365 described above were also built and tested. It is known that different origins of replication may effect the frequency of single copy events in plants (Zhi et al., 2015 Plant Cell Report; 34:745-754); therefore, a variety of origins of replication for both co-habitating and co-integrating plasmids were built and tested and included those described below. Further improvements may be possible using functional variants or derivatives of these or other origins of replication as well.

A T-DNA was included, and comprised the following components: an octopine right border with overdrive, the *Arabidopsis thaliana* ubiquitin 10 promoter, 5'UTR, and intron1 (GenBank NM_202787) driving expression of DsRED2INT, in which the first 363 bp of the *Discosoma* sp. red fluorescent protein (DsRed, Clontech) coding sequence was interrupted by the insertion of the ST-LS1 INTRON2 followed by the last 315 bp of DsRed. A bar gene encoding a phosphinothricin acetyl transferase from *Streptomyces hygroscopicus* with soybean *Glycine max* codon usage for resistance to the herbicide Basta or Bialaphos was included. Plasmids PHP72277, PHD4673 and PHD4674 had the same DNA backbone as PHP70365, but different expression cassettes in the T-DNA as shown in Table 1A.

Plasmid PHP81185 had the same DNA backbone and expression cassette as the T-DNA in PHP70365, but different copies of the vir genes from *Agrobacterium rhizogenes* K599 Ri plasmid as shown in Table 1A. A. rhizo genes strain K599 NCPPB2659 was obtained from the National Collection of Plant Pathogenic Bacteria Central Science Laboratory, Sand Hutton, York YO41 1LZ England (www.ncppb.com).

TABLE 1A

Plasmids

| Plasmid | T-DNA |
| --- | --- |
| PHP70365 (pVIR8; SEQ ID NO: 106) | RB-AtUBQ10::DsRED:PINII_Term-GmUBQ::BAR_GmOT::UBQ14_Term-LB |
| PHP72277 (SEQ ID NO: 109) | RB-AtUBQ10::ZsYellow:PINII_Term-CaMV35S::Hyg::NOS_Term-LB |
| PHD4673 (SEQ ID NO: 110) | RB-AtUBQ10::DsRED::PINII_Term-EF1a::NPTII::SCCAL1_Term-LB |
| PHD4674 (SEQ ID NO: 111) | RB-dMMV::DsRED::PINII_Term-EF1a::NPTII::SCCAL1_Term-LB |
| PHP81185 (SEQ ID NO: 114) | RB-AtUBQ10::DsRED:PINII_Term-GmUBQ::BAR_GmOT::UBQ14_Term-LB |

Co-integrating vectors PHP79752 (BBR1 ORI), PHP79765 (repABC), PHP79767 (PVS1 ORI), PHP81092 (RK2micro), PHP81093 (PSA ORI), PHP81094 (RK2full), and PHP81095 (PSA ORI+PARDE) contained identical DNA backbone and T-DNA but a different origin of replication as shown in Table 1B. Helper vectors PHP79077 (repABC), PHP79759 (BBR1 ORI), PHP79760 (RFS1010 ORI), PHP79761 (PVS1 ORI), PHP80398 (RK2micro), PHP80399 (PSA ORI+PARDE), PHP80402 (PSA ORI), PHP80403 (RK2full), PHP80566 (RK2micro+PARDE), RV005393 (RK2full+PARDE) contained no T-DNA but an identical DNA backbone and different origins of replication as shown in Table 1B. Binary vectors PHP79763 (BBR1 ORI), PHP79764 (RFS1010 ORI), PHP79766 (repABC), PHP79768 (PVS1 ORI), PHP80404 (RK2full+PARDE), PHP80569 (RK2full), RV005199 (PSA ORI), RV005200 (PSA ORI+PARDE), and RV005201 (RK2micro) contained an identical DNA backbone and T-DNA but different origins of replication as shown in Table 1B. Empty boxes in Table 1B indicate that plasmid component was not present.

TABLE 1B

Plasmids for the comparison of the origin of replicon.

| Plasmid | | | |
| --- | --- | --- | --- |
| Co-integration | Helper | Binary | T-DNA |
| PHP79752 (BBR1 ORI, SEQ ID NO: 112) | | | RB-UBQ3_Term::TAGRFP::GMUBQ-GMALS_Term::GMALS ::GMSAMS-CaMV35S::BAR_GmOT::UBQ14_Term-LB |

TABLE 1B-continued

Plasmids for the comparison of the origin of replicon.

| Co-integration | Plasmid Helper | Binary | T-DNA |
|---|---|---|---|
| PHP79765 (repABC, ORI, SEQ ID NO: 57) | | | RB-UBQ3_Term::TAGRFP::GMUBQ-GMALS_Term::GMALS ::GMSAMS-CaMV35S::BAR_GmOT::UBQ14_Term-LB |
| PHP79767 (PVS1 ORI, SEQ ID NO: 3) | | | RB-UBQ3_Term::TAGRFP::GMUBQ-GMALS_Term::GMALS ::GMSAMS-CaMV35S::BAR_GmOT::UBQ14_Term-LB |
| PHP81092 (RK2micro ORI, SEQ ID NO: 54) | | | RB-UBQ3_Term::TAGRFP::GMUBQ-GMALS_Term::GMALS ::GMSAMS-CaMV35S::BAR_GmOT::UBQ14_Term-LB |
| PHP81093 (PSA ORI, SEQ ID NO: 53) | | | RB-UBQ3_Term::TAGRFP::GMUBQ-GMALS_Term::GMALS ::GMSAMS-CaMV35S::BAR_GmOT::UBQ14_Term-LB |
| PHP81094 (RK2full ORI, SEQ ID NO: 38) | | | RB-UBQ3_Term::TAGRFP::GMUBQ-GMALS_Term::GMALS ::GMSAMS-CaMV35S::BAR_GmOT::UBQ14_Term-LB |
| PHP81095 (PSA ORI + PARDE, SEQ ID NO: 56) | | | RB-UBQ3_Term::TAGRFP::GMUBQ-GMALS_Term::GMALS ::GMSAMS-CaMV35S::BAR_GmOT::UBQ14_Term-LB |
| | PHP79077 (repABC ORI, SEQ ID 57) | | |
| | PHP79759 (BBR1 ORI, SEQ ID NO: 112) | | |
| | PHP79760 (RFS1010 ORI, SEQ ID NO: 37) | | |
| | PHP79761 (PVS1 ORI, SEQ ID NO: 3) | | |
| | PHP80398 (RK2micro ORI, SEQ ID NO: 54) | | |
| | PHP80399 (PSA ORI + PARDE, SEQ ID NO: 56) | | |
| | PHP80402 (PSA ORI, SEQ ID NO: 53) | | |
| | PHP80403 (RK2full ORI, SEQ ID NO: 38) | | |
| | PHP80566 (RK2micro ORI, SEQ ID 54 + PARDE, SEQ ID NO: 55) | | |

TABLE 1B-continued

Plasmids for the comparison of the origin of replicon.

| Co-integration | Plasmid | | |
|---|---|---|---|
| | Helper | Binary | T-DNA |
| | RV005393 (RK2full ORI, SEQ ID NO: 38 + PARDE, SEQ ID NO: 55) | | |
| | | PHP79763 (BBR1 ORI, SEQ ID NO: 112) | RB-UBQ3_Term::TAGRFP::GMUBQ-GMALS_Term::GMALS ::GMSAMS-CaMV35S::BAR_GmOT::UBQ14_Term-LB |
| | | PHP79764 (RFS1010 ORI, SEQ ID NO: 37) | RB-UBQ3_Term::TAGRFP::GMUBQ-GMALS_Term::GMALS ::GMSAMS-CaMV35S::BAR_GmOT::UBQ14_Term-LB |
| | | PHP79766 (repABC ORI, SEQ ID NO: 57) | RB-UBQ3_Term::TAGRFP::GMUBQ-GMALS_Term::GMALS ::GMSAMS-CaMV35S::BAR_GmOT::UBQ14_Term-LB |
| | | PHP79768 (PVS1 ORI, SEQ ID NO: 3) | RB-UBQ3_Term::TAGRFP::GMUBQ-GMALS_Term::GMALS ::GMSAMS-CaMV35S::BAR_GmOT::UBQ14_Term-LB |
| | | PHP80404 (RK2full ORI, SEQ ID NO: 38 + PARDE, SEQ ID NO: 55) | RB-UBQ3_Term::TAGRFP::GMUBQ-GMALS_Term::GMALS ::GMSAMS-CaMV35S::BAR_GmOT::UBQ14_Term-LB |
| | | PHP80569 (RK2full ORI, SEQ ID NO: 38) | RB-UBQ3_Term::TAGRFP::GMUBQ-GMALS_Term::GMALS ::GMSAMS-CaMV35S::BAR_GmOT::UBQ14_Term-LB |
| | | RV005199 (PSA ORI, SEQ ID NO: 53) | RB-UBQ3_Term::TAGRFP::GMUBQ-GMALS_Term::GMALS ::GMSAMS-CaMV35S::BAR_GmOT::UBQ14_Term-LB |
| | | RV005200 (PSA ORI + PARDE, SEQ ID NO: 56) | RB-UBQ3_Term::TAGRFP::GMUBQ-GMALS_Term::GMALS ::GMSAMS-CaMV35S::BAR_GmOT::UBQ14_Term-LB |
| | | RV005201 (RK2micro ORI, SEQ ID NO: 54) | RB-UBQ3_Term::TAGRFP::GMUBQ-GMALS_Term::GMALS ::GMSAMS-CaMV35S::BAR_GmOT::UBQ14_Term-LB |

Example 2—Bacteria Screening Using Transient DsRED Expression in Tobacco BY-2 Suspension Culture Tobacco BY-2 cells were provided by RIKEN BRC through the National Bio-Resource Project of the MEXT, Japan. The method of maintenance of tobacco BY-2 suspension cultures was essentially described by Nagata et al. (Int Rev Cytol (1992)132:1-30) and DsRED transient expression was carried out using the modified method of BY-2 suspension cells (Newman et al. (1993) Plant Cell 5:701-714).

From gentamicin resistant strains transformed with PHP70365, 24 bacteria strains showed various levels of DsRED expression in BY-2 cells as observed under the Leica fluorescence stereomicroscope.

Example 3—DNA Extraction and PCR of 16S rDNA

Various analyses were conducted to determine the species of *Ochrobactrum* used for plant transformation. First, genomic DNAs was prepared using MasterPure™ DNA Purification Kit (Cat#MCD85201, Epibio, Madison, Wis., USA). PCR was performed with a PTC-100TM Programmable Thermal Controller (MJ Research, Inc., San Francisco, Calif., USA) using genomic DNAs extracted from 24 bacteria. The primers used for amplification were:

```
16S-F
                                        SEQ ID NO: 102
5' AGAGTTTGATCCTGGCTCAG 3'

16S-R
                                        SEQ ID NO: 103
5' ACGGCTACCTTGTTACGACTT 3'
```

The PCR mixture consisted of 5 µL (100-200 ng) of bacteria DNA, 1.25 µL of 50 mM $MgCl_2$, 0.25 µL of Taq DNA polymerase (5U/µL, GIBCO BRL, Cleveland), 2.5 µL of 10×Taq buffer (GIBCO BRL), 0.5 µL of 10 mM dNTPs, 0.5 µL each of 10 µM primers and 15 µL of sterile distilled water. Samples were heated to 94° C. for 1 min, followed by 30 cycles at 94° C. (30 s), 50° C. (30 s), 72° C. (90 s) and then 72° C. for 10 min. PCR products were cleaned up using MultiScreen® HTS PCR 96-Well Plate (Cat#MSNU 03010, EMD Millipore, Germany).

The resulting PCR products were sequenced by Elim Biopharmaceuticals (Hayward, Calif., USA) and these sequences were used to search the NCBI GenBank database. The top hits from the NCBI GeneBank BLAST search using 1,318 bp of 16S rDNA sequence of EP1A09 (SEQ ID NO: 105) are shown in Table 2. The search results showed that EP1A09 has very high 16S rDNA homology with various Ochrobactrum species (Table 2).

TABLE 2

The top 15 hits from the NCBI GenBank BLAST search

| Source and Sequence | DNA homology % |
|---|---|
| *Ochrobactrum* sp. SJY1 16S ribosomal RNA gene, partial sequence | 100 |
| *Ochrobactrum* sp. MU5-14 16S ribosomal RNA gene | 100 |
| *Ochrobactrum* sp. QW41 16S ribosomal RNA gene, partial sequence | 100 |
| *Ochrobactrum* sp. QW34 16S ribosomal RNA gene, partial sequence | 100 |
| *Ochrobactrum* sp. QW28 16S ribosomal RNA gene, partial sequence | 100 |
| *Ochrobactrum pituitosum* strain SPT1-119a 16S ribosomal RNA gene | 100 |
| Bacterium endosymbiont of *Curculio lateritius* gene for 16S rRNA | 100 |
| *Ochrobactrum* sp. HT13 16S ribosomal RNA gene | 100 |
| *Ochrobactrum* sp. Gp1 16S ribosomal RNA gene | 100 |
| *Ochrobactrum* sp. BS30 16S ribosomal RNA gene | 100 |
| *Ochrobactrum intermedium* partial 16S rRNA gene | 100 |
| *Ochrobactrum* sp. TK14 16S rRNA gene (partial) | 100 |
| Uncultured bacterium clone TX5A_158 16S ribosomal RNA gene | 99 |
| *Ochrobactrum* sp. QW40 16S ribosomal RNA gene | 99 |
| *Ochrobactrum* sp. QW19 16S ribosomal RNA gene | 99 |

Example 4—Further Bacteria Identification by 16S rDNA Sequence, Fatty Acid Methyl Esters (FAME) and Matrix-Assisted Laser Desorption/Ionization (MALDI)-Time of Flight (TOF)

In an attempt to identify the species of EP1A09, the following methods were used: detailed 16S rDNA homology searches of (SEQ ID NO: 104), gas chromatographic analysis of extracted microbial fatty acid ethyl estsers (FAMEs) and time-of-flight mass spectronomy using matrix-assisted laser desorption/ionization (MALDI-TOF). These analyses were carried out by MIDI Labs (Newark, Del., USA).

The 16S rRNA gene was PCR amplified from genomic DNA isolated from pure bacterial colonies. Primers used are universal 16S primers that correspond to positions 0005F and 0531R. Amplification products were purified from excess primers and dNTPs and checked for quality and quantity by running a portion of the products on an agarose gel. Cycle sequencing of the 16S rRNA amplification products was carried out using DNA polymerase and dye terminator chemistry. Excess dye-labeled terminators were then removed from the sequencing reactions. The samples were electrophoresed on 3130 Genetic Analyzer (User Bulletin #2 (2001) ABI PRISM 7700 Sequence Detection System, Applied Biosystems). 16S rDNA sequence of 469 bp from EP1A09 strain did not match MIDI Labs validated library, but when compared to GenBank it resulted in a 99% match at genus level to *Ochrobactrum anthropi* as shown in Table 3.

TABLE 3

GenBank search results with 16S rDNA sequence of EP1A09 strain (D16M2 DNA match report) by MIDI Labs

| Hit | % Diff | Length | Name |
|---|---|---|---|
| 1 | 2.77 | 469 | *Ochrobactrum anthropi* |
| 2 | 3.62 | 469 | *Labrys monochus* |
| 3 | 4.05 | 469 | *Mycoplana ramose* |
| 4 | 4.48 | 469 | *Phyllobacterium myrsinacearum* |
| 5 | 4.48 | 469 | *Rhizobium rhizogenes* |
| 6 | 5.01 | 469 | *Phyllobacterium rubiacearum* |
| 7 | 5.53 | 470 | *Devosia riboflavin* |
| 8 | 6.18 | 469 | *Aminobacter aganoensis* |
| 9 | 6.18 | 469 | *Xanthobacter agilis* |
| 10 | 6.40 | 469 | *Aminobacter aminovorans* |

Fatty acid (FAME) analyses were performed using gas chromatographic analytical system according to MIDI Labs standard procedures (Sasser (1990) in Methods in Phytobacteriology, eds. Klement et al., pp 199-204, Adademiai, Kiado, Budapest; Norman & Yuen (1998) Can J Plant Pathol 20:171-175) and the results showed that species level match to *O. anthropi* which is the only *Ochrobactrum* species in the FAME library at MIDI Labs (Tables 4).

TABLE 4

FAME analysis of EP1A09

A.

| RT | Response | Ar/Ht | RFact | ECL | Peak ID | % |
|---|---|---|---|---|---|---|
| 0.7188 | 239778 | 0.005 | — | 6.6327 | — | — |
| 0.7260 | 1.107E−9 | 0.018 | — | 6.6881 | Solvent | — |
| 2.1759 | 1141 | 0.011 | — | 13.9583 | Unknown 13.951 | — |
| 2.4918 | 801 | 0.012 | — | 14.9888 | 15:0 | — |
| 2.6589 | 702 | 0.011 | 0.952 | 15.5162 | Sum in Feature 2 | 0.31 |
| 2.7602 | 4404 | 0.010 | 0.950 | 15.8370 | Sum in Feature 3 | 1.97 |
| 2.8116 | 8214 | 0.009 | 0.948 | 15.9999 | 16:0 | 3.67 |
| 3.0693 | 382 | 0.008 | 0.945 | 16.8125 | 17:1 w8c | 0.17 |
| 3.0917 | 496 | 0.010 | 0.945 | 16.8833 | 17:1 w6c | 0.22 |
| 3.1288 | 2212 | 0.009 | 0.944 | 17.0002 | 17:0 | 0.98 |
| 3.3948 | 179328 | 0.009 | 0.944 | 17.8457 | Sum in Feature 8 | 79.69 |
| 3.4239 | 484 | 0.009 | 0.944 | 17.9384 | 18:1 w5c | 0.21 |
| 3.4432 | 18975 | 0.009 | 0.944 | 17.9999 | 18:0 | 8.43 |
| 3.4696 | 436 | 0.009 | 0.944 | 18.0856 | 18:1 w7c 11-methyl | 0.19 |
| 3.6948 | 441 | 0.010 | — | 18.8171 | Unknown 18.185 | — |
| 3.7289 | 4255 | 0.010 | 0.947 | 18.9279 | 19:0 cyclo w8c | 1.90 |
| 3.7946 | 2369 | 0.013 | 0.948 | 19.1445 | 18:1 2OH | 1.06 |
| 3.9252 | 1236 | 0.013 | 0.951 | 19.5782 | 18:0 3OH | 0.55 |
| 4.0075 | 1418 | 0.010 | 0.952 | 19.8516 | 20:1 w7c | 0.64 |
| — | 702 | — | — | — | Summed Feature 2 (12:0 aldehyde?; unknown 10.9525) | 0.31 |
| | | | | | (16:1 iso I/14:0 3OH) | — |
| — | 4404 | — | — | — | Summed Feature 3 (16:1 w7c/16:1 w6c) | 1.97 |
| — | 179328 | — | — | — | Summed Feature 8 (18:1 w7c; 18:1 w6c) | 79.69 |

B.

| | |
|---|---|
| ECL Deviation | 0.004 |
| Reference ECL Shift | 0.005 |
| Number Reference Peaks | 3 |
| Total Response | 224912 |
| Total Named | 224912 |
| Percent Named | 100.00% |
| Total Amount | 212447 |
| Match: Sim Index | 0.920 (*Ochrobactrum anthropi*) |
| | 0.705 (*Methybacterium organophilum/ fujisawaense*) |

MALDI-TOF was performed according to the standard procedures (Bizzini et al. (2010) J Clin Micro 5:1549-1554) and the results showed species level match to *O. grignonense* from a MALDI-TOF library of MIDI Labs which containing multiple strains *O. anthropi, O. gallinifaecis, O. grignonense, O, intermedium, Ochrobactrum* sp. and *O. tritici* (Table 5). The scores for each match were evaluated using the score value key.

TABLE 5

A. MALDI-TOF analysis matches

| Rank | Score | Organism | Source |
|---|---|---|---|
| 1 | 2.167 | *Ochrobactrum grignonense* | DSM 13338T HAM |
| 2 | 1.200 | *Ochrobactrum gallinifaecis* | DSM 1529T HAM |
| 3 | 1.186 | *Lactobacillus paracasei* spp *paracasei* | DSM 8741 DSM |
| 4 | 1.174 | *Ochrobactrum intermedium* | LMG 3301T HAM |
| 5 | 1.161 | *Clostridium cadaveris* | 1074_ATCC 25783T BOG |
| 6 | 1.129 | *Aromatoleum diolicum* | 22Lin MPB |
| 7 | 1.103 | *Arthrobacter crystallopoietes* | DSM 20117T DSM |
| 8 | 1.101 | *Arthrobacter luteolus* | DSM 13067T DSM |
| 9 | 1.084 | *Arthrobacter ardleyensis* | DSM 17432T DSM |
| 10 | 1.054 | *Thauera mechernichensis* | Tl1 MPB |

B. Reference of scores for MALDI-TOF analysis

| Range | Confidence Level |
|---|---|
| 2.000-3.000 | Species |
| 2.000-3.000 multiple species | Species, closely related |

TABLE 5-continued

| | |
|---|---|
| 1.700-1.999 | Genus |
| 0.000-1.699 | No match |

Example 5—Genome Assemblies and Characterization of *Ochrobactrum* Isolates by Estimates of Evolutionary Divergence Between 16S rRNA Sequences Draft genomic assemblies were constructed for the novel *Ochrobactrum* strain along with several culture collection strains of *Ochrobactrum* with known identities (Table 6). The genomic DNA was prepared according to a library construction protocol developed by Illumina and sequenced using the Illumina MiSeq. Briefly, after genomic DNA was sheared with a Covaris 5220 instrument, the resulting DNA fragments were end-repaired and their 3' ends treated for A-base addition. After ligation of Illumina-specific adapters and gel-based size-selection, adapter-ligated DNA fragments were subjected to limited PCR amplification with Illumina-specific PCR primers. Cluster generation and paired-end sequencing of the amplified DNA fragments were performed on an Illumina MiSeq, according to Illumina's instructions. A single flow cell was loaded with the DNA fragments from the strain. Sequences and quality scores were generated with the Illumina pipeline software for image analysis and base calling. After initial base calling and processing, the sequencing files generated by the Illumina pipeline were converted to FASTQ format and additional custom quality filtering was performed, such that reads were trimmed if they harbored one or more base at their 3' end with a quality score <15. Paired end Illumina reads (2×150 bp) were assembled with SPAdes 3.1.1 (Bankevich et al. (2012) J Comp Biol 19:455-477) using the default kmer values. In addition, read error correction and mismatch/short INDEL correction was performed with the SPAdes pipeline options. Assembled contigs smaller than 500 bp were removed from the final output.

TABLE 6

| Strains sequenced | |
|---|---|
| Strain ID | Classification |
| DSM 22292 | *Ochrobactrum cicero* |
| DSM 19778 | *Ochrobactrum cytisi* |
| DSM 26944 | *Ochrobactrum daejeonense* |
| DSM 15295 | *Ochrobactrum gallinifaecis* |
| DSM 13338 | *Ochrobactrum grignonense* |
| DSM 22355 | *Ochrobactrum haemotophilum* |
| DSM 16930 | *Ochrobactrum lupine* |
| DSM 17471 | *Ochrobactrum oryzae* |
| DSM 23867 | *Ochrobactrum pectoris* |
| DSM 22207 | *Ochrobactrum* sp. |
| DSM 22354 | *Ochrobactrum pseudogrignonense* |
| DSM 19824 | *Ochrobactrum rhizosphaerae* |
| DSM 18828 | *Ochrobactrum* sp. |
| DSM 7216 | *Ochrobactrum anthropic* |
| DSM 13340 | *Ochrobactrum tritici* |
| HTG3-C-07 | DuPont Pioneer strain - unknown *Ochrobactrum* sp. |
| EP1A09 | DuPont Pioneer strain - unknown *Ochrobactrum* sp. |

The number of base differences per sequence between sequences in the CLUSTALW alignment and evolutionary analyses were conducted in MEGA6 (Tamura et al. (2013) Mol Biol Evol 30:2725-2729). Percent identity was calculated by dividing the number of differences between each pair of sequences by 1,337 bp of 16S rDNA (Tables 7-9).

TABLE 7

Estimates of Evolutionary Divergence (%) between 16S rRNA sequences

| | 1 | 2 | 3 | 4 | 5 | 6 | 7 | 8 | 9 | 10 | 11 | 12 | 13 | 14 | 15 | 16 | 17 | 18 | 19 | 20 |
|---|---|---|---|---|---|---|---|---|---|---|---|---|---|---|---|---|---|---|---|---|
| 1 | 100 | 97.7 | 96.7 | 95.4 | 98.2 | 98.7 | 100 | 96.2 | 97.5 | 98.1 | 98.3 | 98.3 | 100 | 98.6 | 99.6 | 100 | 98.2 | 95.5 | 98.7 | 98.7 |
| 2 | | 100 | 98.1 | 95.0 | 96.3 | 97.2 | 97.7 | 97.0 | 96.5 | 96.0 | 96.3 | 96.0 | 97.7 | 96.3 | 97.6 | 97.7 | 95.9 | 95.1 | 98.4 | 98.4 |
| 3 | | | 100 | 94.8 | 96.0 | 97.1 | 96.7 | 96.9 | 97.5 | 96.9 | 95.9 | 96.8 | 96.7 | 95.9 | 96.6 | 96.7 | 96.7 | 95.1 | 97.1 | 97.1 |
| 4 | | | | 100 | 95.9 | 95.9 | 95.4 | 96.9 | 95.7 | 95.3 | 96.0 | 95.7 | 95.4 | 96.0 | 95.6 | 95.4 | 95.3 | 93.6 | 94.9 | 94.9 |
| 5 | | | | | 100 | 98.2 | 98.2 | 95.6 | 97.3 | 98.5 | 99.0 | 98.1 | 98.2 | 99.2 | 98.0 | 98.2 | 98.7 | 95.1 | 97.2 | 97.2 |
| 6 | | | | | | 100 | 98.7 | 95.9 | 97.8 | 97.8 | 98.0 | 98.0 | 98.7 | 98.1 | 98.7 | 98.7 | 97.9 | 95.4 | 97.9 | 97.9 |
| 7 | | | | | | | 100 | 96.2 | 97.5 | 98.1 | 98.3 | 98.3 | 100 | 98.6 | 99.6 | 100 | 98.2 | 95.5 | 98.7 | 98.7 |
| 8 | | | | | | | | 100 | 95.7 | 95.0 | 95.7 | 95.2 | 96.2 | 95.5 | 95.9 | 96.2 | 95.1 | 95.5 | 96.6 | 96.6 |
| 9 | | | | | | | | | 100 | 97.8 | 96.9 | 97.8 | 97.5 | 97.2 | 97.7 | 97.5 | 97.8 | 94.1 | 96.4 | 96.4 |
| 10 | | | | | | | | | | 100 | 98.6 | 99.3 | 98.1 | 98.7 | 97.8 | 98.1 | 99.9 | 94.7 | 96.9 | 96.9 |
| 11 | | | | | | | | | | | 100 | 98.4 | 98.3 | 99.3 | 97.9 | 98.3 | 98.7 | 95.3 | 97.5 | 97.5 |
| 12 | | | | | | | | | | | | 100 | 98.3 | 98.7 | 97.9 | 98.3 | 99.5 | 95.0 | 97.2 | 97.2 |
| 13 | | | | | | | | | | | | | 100 | 98.6 | 99.6 | 100 | 98.2 | 95.5 | 98.7 | 98.7 |
| 14 | | | | | | | | | | | | | | 100 | 98.4 | 98.6 | 98.9 | 95.0 | 97.8 | 97.8 |
| 15 | | | | | | | | | | | | | | | 100 | 99.6 | 97.8 | 95.3 | 98.4 | 98.4 |
| 16 | | | | | | | | | | | | | | | | 100 | 98.2 | 95.5 | 98.7 | 98.7 |
| 17 | | | | | | | | | | | | | | | | | 100 | 94.8 | 97.0 | 97.0 |
| 18 | | | | | | | | | | | | | | | | | | 100 | 95.4 | 95.4 |
| 19 | | | | | | | | | | | | | | | | | | | 100 | 100 |
| 20 | | | | | | | | | | | | | | | | | | | | 100 |

TABLE 8

Names of organisms listed in Table 7

| Table 7 No. | Organism Name |
|---|---|
| 1 | DSM19778 Ochrobactrum cytisi |
| 2 | DSM22292 Ochrobactrum cicero |
| 3 | DSM26944 Ochrobactrum daejeonense |
| 4 | DSM15295 Ochrobactrum gallinifaecis |
| 5 | DSM13338 Ochrobactrum grignonense |
| 6 | DSM22355 Ochrobactrum haemotophilum |
| 7 | DSM16930 Ochrobactrum lupine |
| 8 | DSM17471 Ochrobactrum oryzae |
| 9 | DSM23867 Ochrobactrum pectoris |
| 10 | DSM22207 Ochrobactrum pituitosum |
| 11 | DSM22354 Ochrobactrum pseudogrignonense |
| 12 | DSM19824 Ochrobactrum rhizosphaerae |
| 13 | DSM18828 Ochrobactrum sp |
| 14 | DSM7216 Ochrobactrum thiophenivorans |
| 15 | DSM13340 Ochrobactrum daejeonense |
| 16 | HTG3-C-07 |
| 17 | EP1A09 |
| 18 | Agrobacterium rhizogenes strain NBRC 13257 |
| 19 | Brucella suis 1330 |
| 20 | Brucella abortus bv. 1 str. 9-941 |

TABLE 9

Estimates of Evolutionary Divergence (%) between EP1A09 and other 16S rRNA sequences

| 16S rRNA source | % Identity to EP1A09 |
|---|---|
| DSM19778 Ochrobactrum cytisi | 98.2 |
| DSM22292 Ochrobactrum ciceri | 95.9 |
| DSM26944 Ochrobactrum daejeonense | 96.7 |
| DSM15295 Ochrobactrum gallinifaecis | 95.3 |
| DSM13338 Ochrobactrum grignonense | 98.7 |
| DSM22355 Ochrobactrum haemotophilum | 97.9 |
| DSM16930 Ochrobactrum lupini | 98.2 |
| DSM17471 Ochrobactrum oryzae | 95.1 |
| DSM23867 Ochrobactrum pecoris | 97.8 |
| DSM22207 Ochrobactrum pituitosum | 99.9 |
| DSM22354 Ochrobactrum pseudogrignonense | 98.7 |
| DSM19824 Ochrobactrum rhizosphaerae | 99.5 |
| DSM18828 Ochrobactrum sp. | 98.2 |
| DSM7216 Ochrobactrum thiophenivorans | 98.9 |
| DSM13340 Ochrobactrum daejeonense | 97.8 |
| HTG3-C-07 | 98.2 |
| EP1A09 | 100 |
| Agrobacterium rhizogenes strain NBRC 13257 | 94.8 |
| Brucella suis 1330 | 97.0 |
| Brucella_abortus bv. 1 str. 9-941 | 97.0 |

Example 6—Multilocus Sequence Typing of Ochrobactrum Strains

Multilocus sequence analysis (MLSA) of Ochrobactrum strains were carried out using the scheme described by Romano et al. 2009. These are the seven loci used for the MLSA scheme:
(1) >gi|256809827|gb|ACV31014.1|chorismate synthase, partial [Ochrobactrum anthropi ATCC 49188];
(2) >gi|256809699|gb|ACV30950.1| 70 kDa heat shock protein, partial [Ochrobactrum anthropi ATCC 49188];
(3) >gi|256809647|gb|ACV30924.1| glyceraldehyde-3-phosphate dehydrogenase, partial [Ochrobactrum anthropi ATCC 49188];
(4) >gi|256809455|gb|ACV30828.1| 25 kDa outer membrane protein, partial [Ochrobactrum anthropi ATCC 49188];
(5) >gi|256809287|gb|ACV30744.1| recombinase A, partial [Ochrobactrum anthropi ATCC 49188];
(6) >gi|256809135|gb|ACV30668.1| DNA-dependent RNA polymerase beta subunit, partial [Ochrobactrum anthropi ATCC 49188]; and
(7) >gi|256808991|gb|ACV30596.1| anthranilate synthase, partial [Ochrobactrum anthropi ATCC 49188].

Figure 1B:
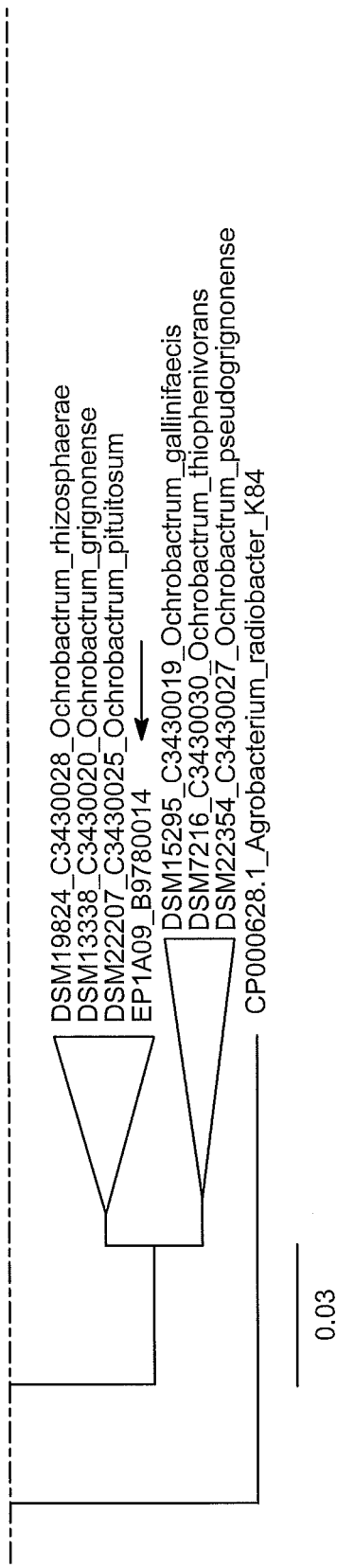

The evolutionary history was inferred by using the Maximum Likelihood method based on the Tamura-Nei model (Tamura & Nei (1993) Mol Biol Evol 10:512-526). The bootstrap consensus tree inferred from 100 replicates was taken to represent the evolutionary history of the taxa analyzed (Felsenstein (1985) Evolution 39:783-791). Branches corresponding to partitions reproduced in less than 50% bootstrap replicates were collapsed. The percentage of replicate trees in which the associated taxa clustered together in the bootstrap test (100 replicates) was shown next to the branches. Initial tree(s) for the heuristic search were obtained automatically by applying Neighbor-Join and BioNJ algorithms to a matrix of pairwise distances estimated using the Maximum Composite Likelihood (MCL) approach, and then selecting the topology with superior log likelihood value. The analysis involved 42 nucleotide sequences. Codon positions included were 1st+2nd+3rd+Noncoding. All positions containing gaps and missing data were eliminated. There were a total of 3456 positions in the final dataset. Evolutionary analyses were conducted in MEGA6 (Tamura et al. (2013) Mol Biol Evol 30:2725-2729). The final tree was drawn with the FigTree program (available online at tree-dot-bio-dot-ed-dot-ac-dot-uk/software/figtree/) as shown in FIG. 1A and FIG. 1B. This resulting phylogenetic tree demonstrates that the isolate EP1A09 is a new species of Ochrobactrum. This new isolate, EP1A09, was deposited on Jul. 10, 2015 under Accession Number NRRL B-67078 with the Agricultural Research Service Culture Collection (NRRL) and is named Ochrobactrum haywardense H1.

Example 7—Stable Transformation of Tobacco

Tobacco leaf disk transformation was done essentially as described by Gallois and Marinho (Methods Mol Biol (1995) 49:39-48). Tobacco plants (Nicotiana tabacum cv Petite Havana SR1, Catalog #NT-02-20-01, Lehle Seeds, Round Rock, Tex.) are aseptically cultured in the sterile polypropylene container (Catalog #0701, International Container Corp, Severn, Md.) containing half-strength Murashige and Skoog (MS) medium with 1.5% sucrose and 0.3% Gelrite under 16 hrs light (80-110 $\mu E/m^2/s$ cool white fluorescent lamps) at 24° C. in vitro. Stems with one node were cut out from grown plantlets and then transferred to fresh half-strength MS every 4-6 weeks under the same environmental conditions.

Figure 2A:
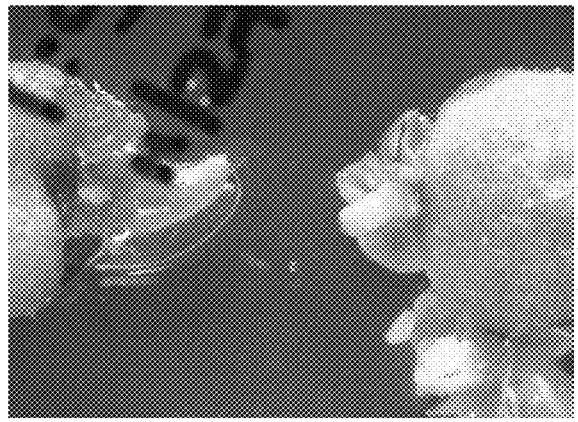
Figure 2B:
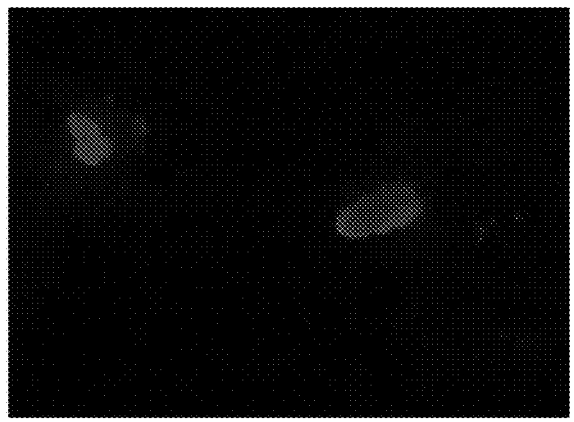
Figure 2C:
Figure 2D:
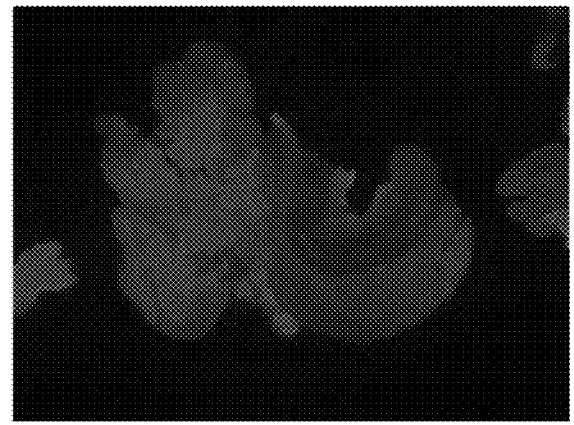

Log phase Ochrobactrum haywardense H1 NRRL Deposit B-67078 cultures, with and without the plant transformation vector PHP70365, were centrifuged at 1,500×g for 10 minutes and the cell pellet of Ochrobactrum were then diluted to an OD600 nm of 0.5 with liquid co-cultivation medium composed of MS medium (pH 5.2) with 2 mg/L $N^6$-benzyladenine (BA), 1% glucose and 200 μM acetosyringone. Leaf disks were obtained from 3-4 week-old tobacco plants grown in vitro. Sterile tobacco leaves were excised from plants and soaked in 20 mL of EP1A09 (OD=0.5) (Ochrobactrum haywardense H1 NRRL Deposit B-67078) in liquid co-cultivation medium in 100×25 mm Petri dishes for 5 min. Leaves were then cut into 3×3 mm segments and the leaf pieces were then fully submerged in 20 mL of Ochrobactrum for 5 mins. Leaf segments were blotted onto autoclaved filter paper, then incubated on solid co-cultivation medium composed of MS medium (pH 5.2) with 2 mg/L BA, 1% glucose, 200 µM acetosyringone and Phytoagar (Catalog #A175, PhytoTechnology Laboratories, Shawnee Mission, Kans.) under 16 hrs light (80-110 µE/m²/s, cool white fluorescent lamps) at 24° C. After 3 days of co-cultivation, 20 leaf segments/plate were transferred to shoot induction medium composed of MS solid medium (pH 5.7) with 2 mg/L BA, 3% sucrose, 0.3% Gelrite, 3 mg/L bialaphos and 250 µg/mL Cefotaxime. The levels of expression for DsRED fluorescent protein were observed under the Leica fluorescence stereomicroscope (Leica, Wetzlar, Germany) equipped with a filter set for excitation at 530-560 nm and emission at 590-650 nm. Transient expression of DsRED foci were observed following three days of co-cultivation and bialaphos resistant callus and shoot buds expressing stable DsRED were observed three weeks after transformation (FIG. 2B). Bialaphos resistant callus and shoots were transferred to fresh shoot induction medium for the shoot propagation and the results as visualized with DsRED expression seven weeks (FIG. 2D) after transformation. FIG. 2D demonstrated that *Ochrobactrum haywardense* H1 NRRL Deposit B-67078 further comprising PHP70365 can stably transform tobacco plants.

Cotton callus was initiated from Coker 312 and was transformed with *Ochrobactrum haywardense* H1 NRRL Deposit B-67078 cultures harboring PHP72477.

Example 8—Soybean Half Seed Transformation

Soybean transformation was done essentially as described by Paz et al. ((2006) Plant Cell Rep 25:206-213) and U.S. Pat. No. 7,473,822. Mature seed from soybean lines were surface-sterilized for 16 hrs using chlorine gas, produced by mixing 3.5 mL of 12 N HCl with 100 mL of commercial bleach (5.25% sodium hypochloride), as described by Di et al. ((1996) Plant Cell Rep 15:746-750). Disinfected seeds were soaked in sterile distilled water at room temperature for 16 hrs (100 seeds in a 25×100 mm petri dish). The compositions of various cultivation media used for soybean half seed transformation and plant regeneration is summarized in Table 10.

A volume of 10 mL of *Ochrobactrum haywardense* H1 NRRL Deposit B-67078 further containing vector PHP70365 (SEQ ID NO: 106) suspension at OD600=0.5 in infection medium containing 300 µM acetosyringone was added to the soaked seeds. The seeds were then split by cutting longitudinally along the hilum to separate the cotyledons, and the seed coats, primary shoots, and embryonic axes were removed in *Ochrobactrum haywardense* H1 NRRL Deposit B-67078 suspension, thereby generating half-seed explants. The half-seed explants were placed flat side down in a deep plate with 4 mL fresh *Ochrobactrum*/infection media with no overlapping of cotyledons. The plates were sealed with parafilm ("Parafilm M" VWR Cat#52858), then sonicated (Sonicator-VWR model 50T) for 30 seconds. After sonication, half-seed explants were transferred to a single layer of autoclaved sterile filter paper (VWR#415/Catalog #28320-020) onto co-cultivation solid medium (18-22 explants per plate; flat side down). The plates were sealed with Micropore tape (Catalog #1530-0, 3M, St. Paul, Minn.)) and incubated under dim light (5-10 µE/m²/s, cool white fluorescent lamps) for 16 hrs at 21° C. for 5 days.

After co-cultivation, the half-seed explants were washed in liquid shoot induction (SI) medium once then the explants were cultured on shoot induction medium solidified with 0.7% agar in the absence of selection. The base of the explant (i.e., the part of the explant from where the embryonic axis was removed) was embedded in the medium, facing upwards. Shoot induction was carried out in a Percival Biological Incubator at 24° C. with a photoperiod of 18 hrs and a light intensity of 130-160 µE/m²/s. After 14 days, the explants were transferred to fresh shoot induction medium containing 3 mg/L bialaphos. The half seed explants were transferred to fresh medium every two weeks. After four weeks of culture on shoot induction medium, explants were transferred to shoot elongation (SE) medium containing 5 mg/L bialaphos (Table 10). Six to ten weeks later, elongated shoots (>1-2 cm) were isolated and transferred to rooting medium (Table 10) containing 1 mg/L bialaphos.

TABLE 10

Cultivation media for soybean transformation

| | Infection | Co-cultivation | Shoot induction (SI) | Shoot elongation (SE) | Rooting |
|---|---|---|---|---|---|
| Gamborg B5 Basal Medium (g/L) (Phytotech G398) | 0.321 | 0.321 | 3.21 | — | — |
| MS Modified Basal Medium with Gamborg Vitamins (g/L) (Phytotech M404) | — | — | — | 4.44 | 2.22 |
| Sucrose (g/L) (Phytotech S391) | 30 | 30 | 30 | 30 | 20 |
| MES (g/L) | 4.26 | 4.26 | 0.64 | 0.64 | 0.64 |
| pH | 5.4 | 5.4 | 5.7 | 5.7 | 5.6 |
| TC agar (g/L) (Phytotech A175) | — | 4.25 | 7 | 7 | 7 |
| Asparagine (Phytotech A107) stock 20 mg/ml | — | — | — | 50 mg/L | — |
| Pyroglutamic Acid (Fluka 83160) stock 100 mg/ml | — | — | — | 100 mg/L | — |
| IAA | — | — | — | 0.1 mg/L | — |
| IBA | — | — | — | — | 1 mg/L |

TABLE 10-continued

Cultivation media for soybean transformation

| | Infection | Co-cultivation | Shoot induction (SI) | Shoot elongation (SE) | Rooting |
|---|---|---|---|---|---|
| GA3 (Phytotech G358) | 0.25 mg/L | 0.25 mg/L | — | 0.5 mg/L | — |
| Zeatin-Riboside | — | — | — | 0.1 mg/L | — |
| BAP (Sigma B3274) stock 1 mg/ml | 1.67 mg/L | 1.67 mg/L | 1.11 mg/L | — | — |
| BCDA (Bathocuproinedi-sulfonic acid disodium salt) (Sigma B1125) stock 118 mM 0.2 ml/l | 847 µl/L | 847 µl/L | — | — | — |
| Acetosyringone (Aldrich D13, 440-6) stock 1M (final 200 µM) | — | 0.2 ml/L | — | — | — |
| Timentin (Goldbio T-104-100) | — | — | 150 mg/L | 150 mg/L | 100 mg/L |
| Cefotaxime (Phytotech C380) | — | — | 150 mg/L | 150 mg/L | 100 mg/L |
| Bialaphos | — | — | 3 mg/L | 5 mg/L | 1 mg/L |

Figure 3A:
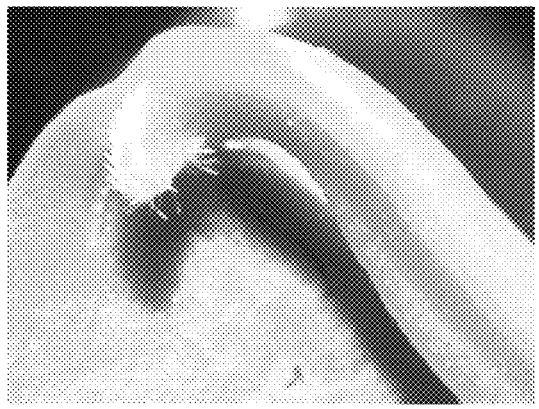
Figure 3B:
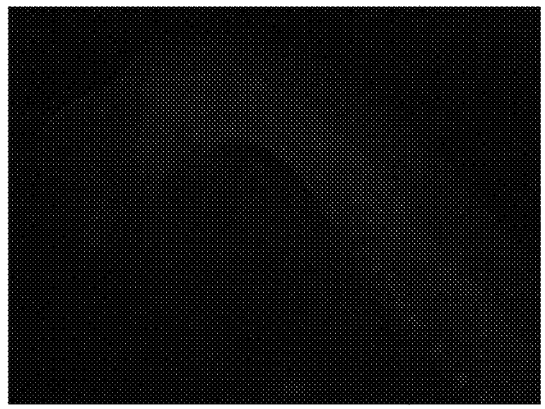
Figure 3C:
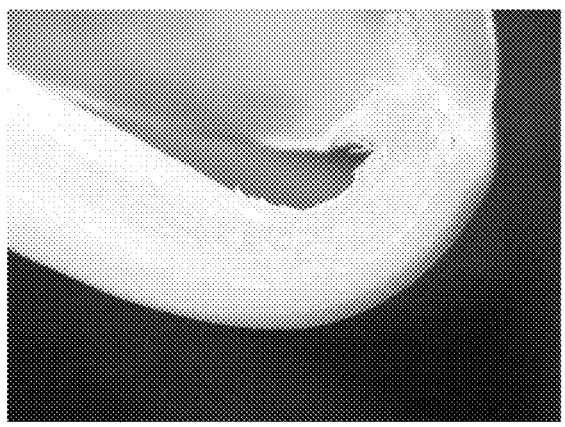
Figure 3D:
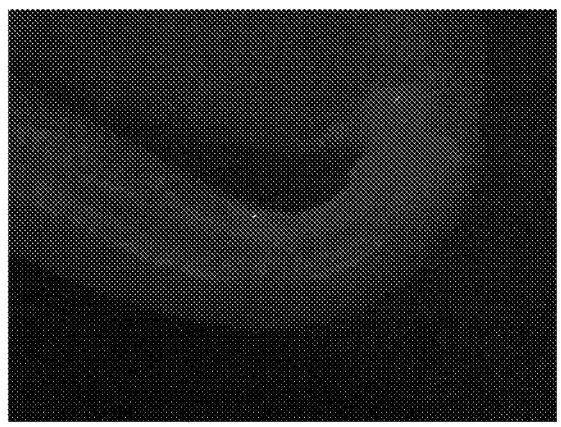
Figure 4A:
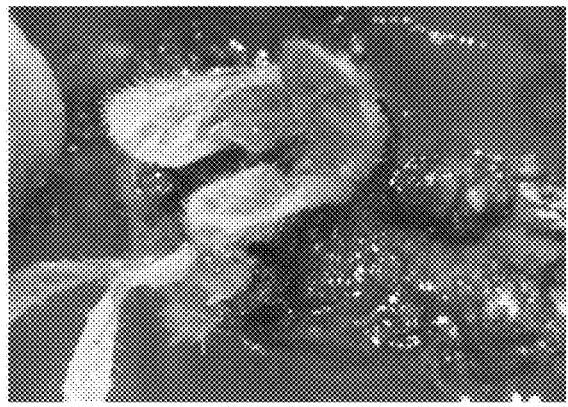
Figure 4B:
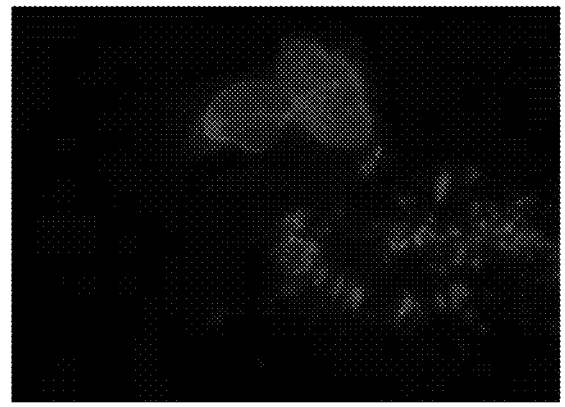
Figure 4C:
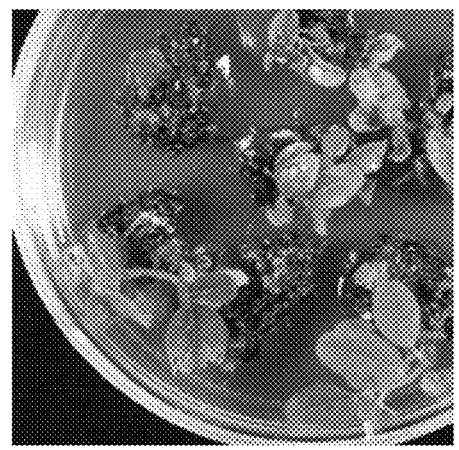
Figure 4D:
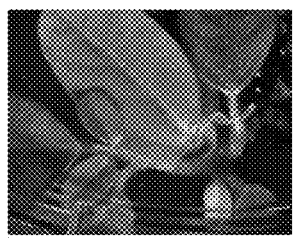
Figure 4E:
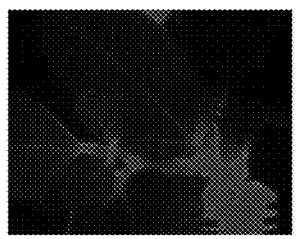
Figure 4F:
Figure 4G:
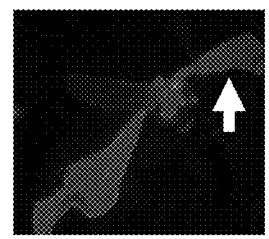
Figure 4H:
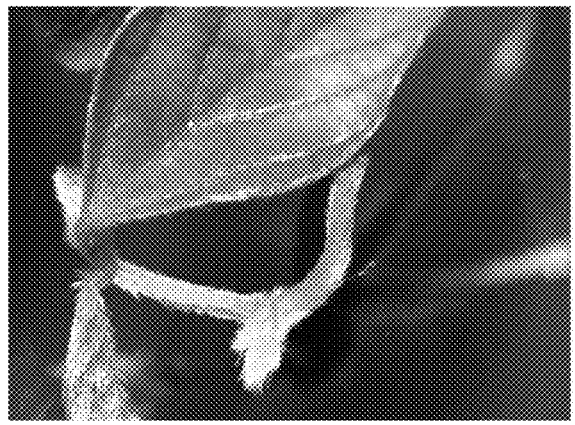
Figure 4I:
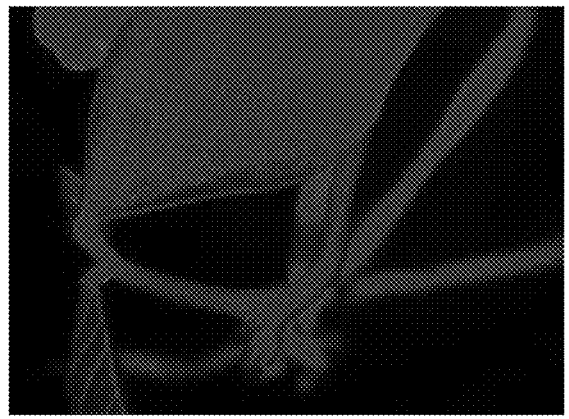
Figure 4J:

Transient DsRED expression in explants transformed with *Ochrobactrum haywardense* H1 NRRL Deposit B-67078 further comprising PHP70365 was obtained five days after co-cultivation, but soybean explants transformed with *Ochrobactrum haywardense* H1 NRRL Deposit B-67078 empty (vector) didn't show any DsRED expression (FIG. 3B). DsRED-positive shoots were observed in Jack and DuPont Pioneer elite cultivars 2-3 weeks after transformation with *Ochrobactrum haywardense* H1 NRRL Deposit B-67078(PHP70365) on the shoot initiation medium containing bialaphos 3 mg/L (FIG. 4B). Stably transformed DsRED-positive shoots 1-2 cm in size were observed in 10-12 weeks after transformation with *Ochrobactrum haywardense* H1 NRRL Deposit B-67078, further comprising PHP70365 (FIG. 4C-FIG. 4G) and were able to root successfully (FIG. 4H-FIG. 4I). These T0 plantlets were subsequently transferred to soil (FIG. 4J).

Transformation efficiencies of *Ochrobactrum haywardense* H1 NRRL Deposit B-67078 further comprising PHP70365 in DuPont Pioneer elite soybean cultivars are summarized in Table 11. DsRED positive shoots were recovered at an average of 1 per 100 infected cotyledons. About 70% of these DsRED positive plants went on to root successfully in the bialaphos rooting medium.

Crude extracts were prepared from the leaf tissues of DsRED positive and bialaphos resistant soybean events transformed with *Ochrobactrum haywardense* H1 NRRL Deposit B-67078 further comprising PHP70365 using Pellet pestles (Cat#Nalge Nunc International, Rochester, N.Y., USA) in 1.5 mL Eppendorf tubes. An AgraStrip® LL strip (Cat#7800019, Romer Labs Inc, Union, Mo., USA) was placed into each extraction sample and allowed to develop for 2-10 minutes. All DsRED positive events gave a positive reaction on the AgraStrip® LL test indicating bar gene expression, while an untransformed control (WT) plant showed negative result (no bar gene expression).

TABLE 11

Stable transformation efficiencies of *Ochrobactrum haywardense* H1 NRRL Deposit B-67078 further comprising PHP70365 in DuPont Pioneer elite soybean cultivars.

| Experiments | Cultivar | # explants | # events DsRED+ | # DsRED + rooted (%) |
|---|---|---|---|---|
| 1 | 93Y21 | 89 | 3 | 3 (3.4%) |
|   | 93Y41 | 84 | 1 | 0 |
|   | 93Y53 | 66 | 1 | 0 |
|   | 93Y83 | 30 | 0 | 0 |
| 2 | 93Y21 | 168 | 1 | 1 (0.6%) |
| 3 | 93Y21 | 10 | 1 | 1 (10%) |
| | Total | 447 | 7 (1.6%) | 5 (1.1%) |

Example 9—Plant Phenotypes and T1 Seed Segregations of Transgenic Soybean

Transgenic plantlets transformed with *Ochrobactrum haywardense* H1 NRRL Deposit B-67078 further comprising PHP70365 were transferred to moistened Jiffy-7 peat pellets (Jiffy Products Ltd, Shippagan, Canada), and kept enclosed in clear plastic tray boxes until acclimatized in Percival incubator at conditions of 16 hour photoperiod at 60-100 µE/m$^2$/s, 26° C./24° C. day/night temperatures (FIG. 4J). Hardened plantlets were potted in 2 gallon pots containing moistened SunGro 702 propagation mix (770 Silver Street, AGAWAM, Mass. 01001) and grown to maturity for harvest in a greenhouse. Five of the transgenic plants appeared to be morphologically normal while one was stunted possibly due to the overexpression of DsRED. Signs of DsRED toxicity or reduced regenerability or phenotypic effects were observed with the DsRED overexpressing transgenic soybean plants in in vitro and in the greenhouse, compared with untransformed wild type plants. Leaf tissues from T0 plants in the greenhouse were collected and qPCR analyses conducted to determine the copy numbers of transgenes in T-DNA (RB-ATUBQ10:DsRED:PINII Term-GMUBQ:BAR GMOT:UBQ14Term-LB) of PHP70365.

Four (event numbers 277793891, 279161306, 279161388 and 278728430) out of five T0 events contained a single copy of the DsRED and BAR expression cassettes from T-DNA of PHP70365 (Table 12), Event 274749446 had more than one copy of some of the introduced sequences.

TABLE 12

Copy number of transgenes in transgenic T0 soybean plants transformed with *Ochrobactrum haywardense* H1 NRRL Deposit B-67078 further comprising PHP70365 by qPCR analysis.

| Identifier | UBQ10 pro (DsRED) | DsRED | PinII Ter (DsRED) | Bar | UBQ14 ter (Bar) |
|---|---|---|---|---|---|
| 274749446 | 2 | 1 | 1 | 2 | 2 |
| 277793891 | 1 | 1 | 1 | 1 | 1 |
| 279161306 | 1 | 1 | 1 | 1 | 1 |
| 279161388 | 1 | 1 | 1 | 1 | 1 |
| 278728430 | 1 | 1 | 1 | 1 | 1 |

All five of the T0 plants flowered normally and produced T1 seeds. T1 seeds from these five events exhibited strong DsRED expression under both fluorescence microscopy and ambient light. The observed ratios of DsRED expressing to non-expressing T1 seeds from 5 transgenic events were 391:146, 162:48, 98:26, 119:49 and 170:66, respectively, which are consistent with a 3:1 Mendelian segregation ratio for a dominant gene at a single locus (Table 13).

TABLE 13

Number of T1 seeds collected and DsRED segregation from transgenic soybean plants transformed with *Ochrobactrum haywardense* H1 NRRL Deposit B-67078 further comprising PHP70365.

| Identifier | Number of T1 seeds | DsRED+ | DsRED− | DsRED segregation |
|---|---|---|---|---|
| 274749446 | 537 | 391 | 146 | 2.7:1 |
| 277793891 | 210 | 162 | 48 | 3.4:1 |
| 279161306 | 124 | 98 | 26 | 3.8:1 |
| 279161388 | 168 | 119 | 49 | 2.4:1 |
| 278728430 | 236 | 170 | 66 | 2.6:1 |

Example 10—Soybean Transformation

Figure 5A:
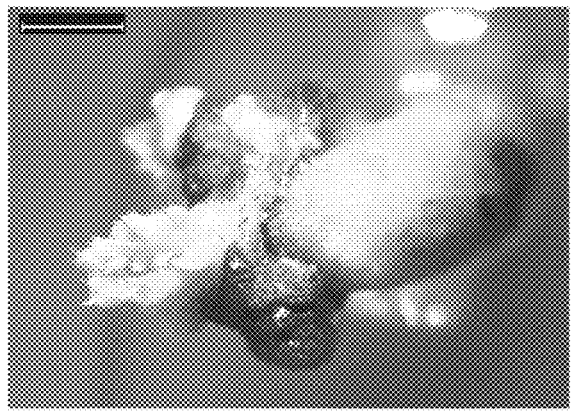
Figure 5B:
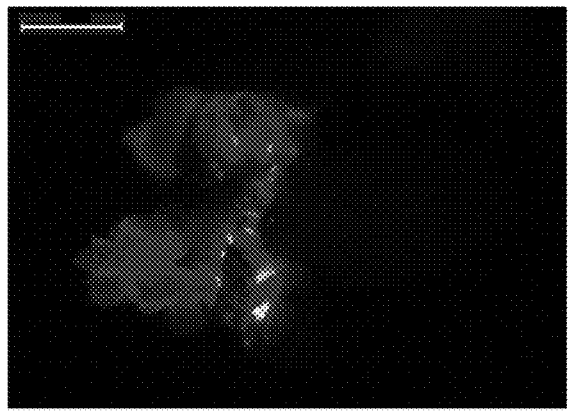
Figure 5C:
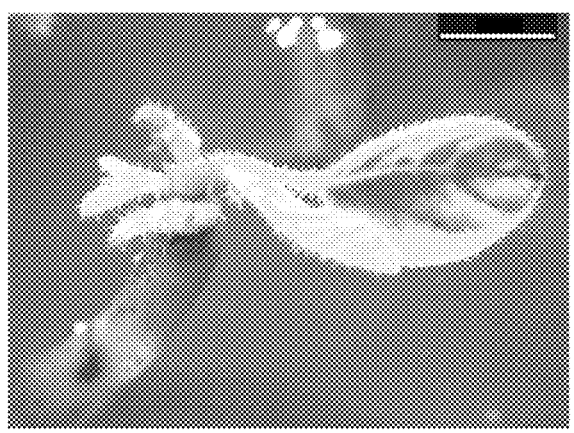
Figure 5D:
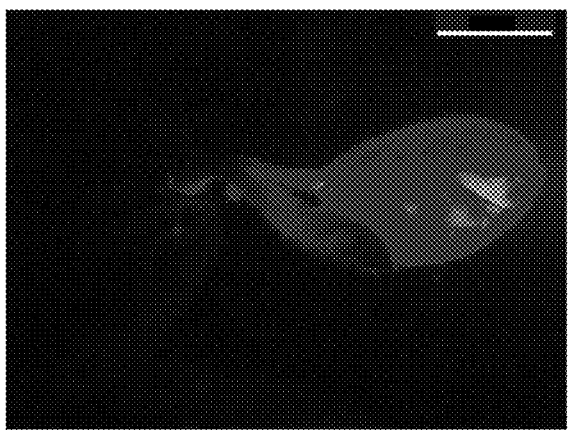
Figure 6A:
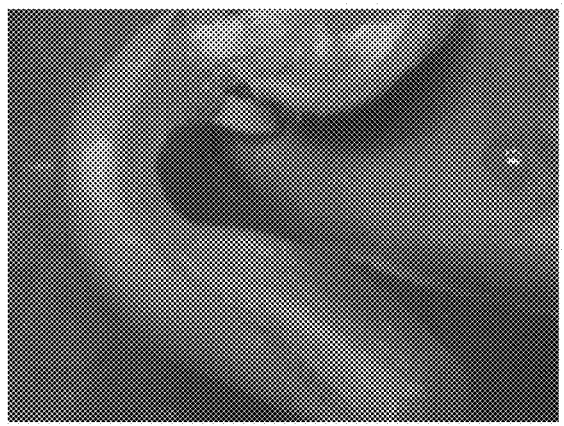
Figure 6B:
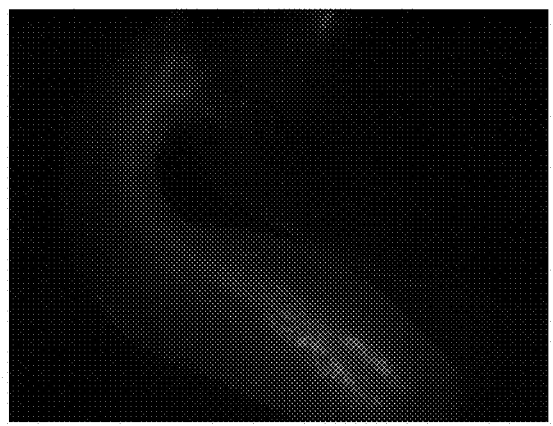
Figure 6C:
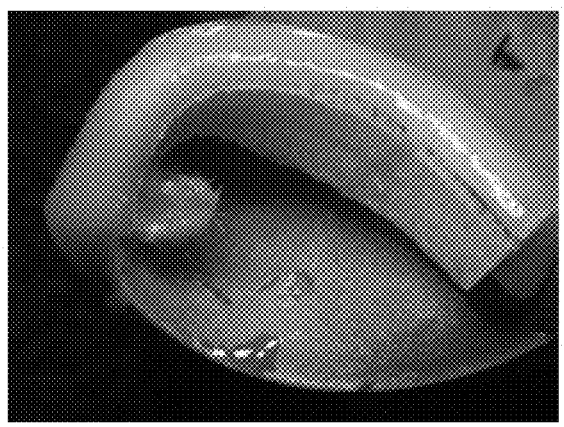
Figure 6D:
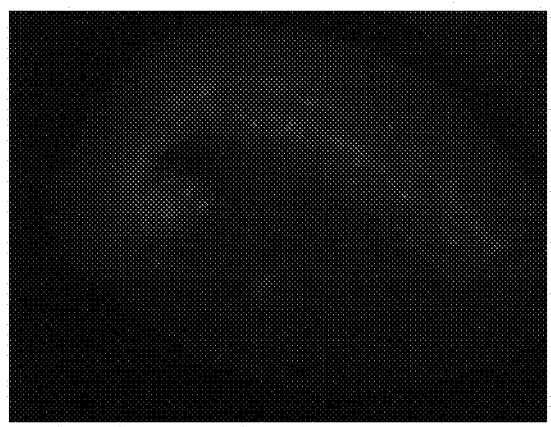
Figure 6E:
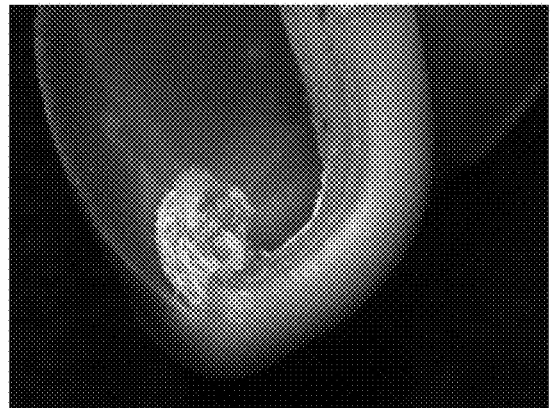
Figure 6F:
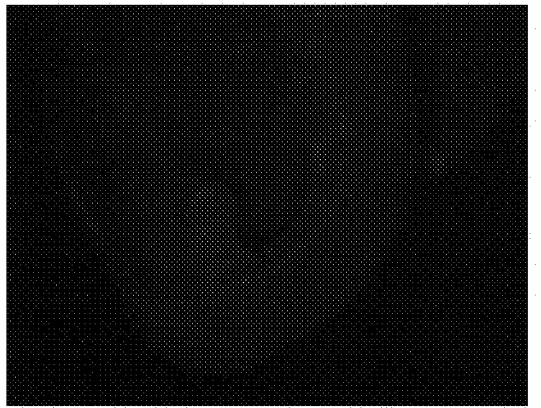

Mature dry seeds were disinfected using chlorine gas and imbibed on semi-solid medium containing 5 g/l sucrose and 6 g/l agar at room temperature in the dark. After an overnight incubation, the seed was soaked in distilled water for an additional 3-4 hrs at room temperature in the dark. Intact embryonic axis were isolated from cotyledon using a scapel blade. *Ochrobactrum*-mediated embryonic axis transformation was carried out using the protocols as described in Example 9. Transient DsRED expression in the meristem region of the embryonic axis transformed with *Ochrobactrum haywardense* H1 NRRL Deposit B-67078 further comprising PHP70365 was observed 3-4 days after co-cultivation. DsRED-positive shoot primordia and callus in the meristematic region were observed 2-3 weeks after transformation with *Ochrobactrum haywardense* H1 NRRL Deposit B-67078 further comprising PHP70365 on the shoot initiation medium containing bialaphos 3 mg/L (FIG. 5B). Stably transformed DsRED positive shoots 1-1.5 cm in size were produced in 6-8 weeks after transformation with *Ochrobactrum haywardense* H1 NRRL Deposit B-67078 further comprising PHP70365 (FIG. 5D).

Example 11—Alternative *Ochrobactrum* Strains to Transform Plant Cells

Sixteen *Ochrobactrum* strains were from DSMZ (Deutsche Sammlung von Mikroorganismen and Zellkulturen GmbH, Germany) and 2 strains were obtained from Dr. Tamas Torok, Lawrence Berkeley National Laboratory (Berkeley, Calif.) as shown in Table 14 and the strains were cultured as per instructions from the supplier. All 16 strains were susceptible to gentamicin at 100 mg/L, but only 8 strains (*Ochrobactrum cytisi*, *O. daejeonense*, *O. lupine*, *O. oryzae*, *O. pecoris*, and *O. tritici*, LBNL124-A-10 and HTG3-C-07) were transformable with PHP70365 with gentamicin selection after electroporation. These 8 strains and *Ochrobactrum haywardense* H1 NRRL Deposit B-67078 were tested for their ability to genetically transform tobacco BY-2 cells (using PHP72277 that has a YFP expression cassette) and soybean half seed (using PHP70365 which has a DsRED cassette). In addition to *Ochrobactrum haywardense* H1 NRRL Deposit B-67078, *O. cytisi* and *O. pecoris* were able to transform BY-2 cells (Table 14) and soybean explants (FIG. 6). *O. daejeonense*, *O. lupine*, *O. oryzae*, and *O. tritici* were also able to transform tobacco BY-2 cells but their transformation efficacies were significantly (10-50 times) lower than *Ochrobactrum haywardense* H1 NRRL Deposit B-67078, *O. cytisi* and *O. pecoris*. In Table 14, "X" notes that not any colonies transformed with plasmid PHP70365 were obtained. "O" notes that colonies transformed with plasmid PHP70365 were obtained. "ND" notes not determined. More + showed higher transient fluorescent protein expression.

TABLE 14

*Ochrobactrum* strains

| *Ochrobactrum* Strains | Source | PHP70365 delivery into strains | Transient DsRED or YFP expression in BY-2 |
|---|---|---|---|
| (1) *O. cicero* | DSM 22292 | X | ND |
| (2) *O. cytisi* | DSM 19778 | O | ++ |
| (3) *O. daejeonense* | DSM 26944 | O | + |
| (4) *O. gallinifaecis* | DSM 15295 | X | ND |
| (5) *O. grignonense* | DSM 13338 | X | ND |
| (6) *O. haematophilum* | DSM 22355 | X | ND |
| (7) *O. lupini* | DSM 16930 | O | + |
| (8) *O. oryzae* | DSM 17471 | O | + |
| (9) *O. pecoris* | DSM 23867 | O | ++ |
| (10) *O. pituitosum* | DSM 22207 | X | ND |
| (11) *O. pseudintermedium* | DSM 17490 | X | ND |

TABLE 14-continued

Ochrobactrum strains

| Ochrobactrum Strains | Source | PHP70365 delivery into strains | Transient DsRED or YFP expression in BY-2 |
|---|---|---|---|
| (12) *O. pseudogrignonense* | DSM 22354 | X | ND |
| (13) *O. rhizosphaerae* | DSM 19824 | X | ND |
| (14) *Ochrobactrum* sp. | DSM 18828 | X | ND |
| (15) *O. thiophenivorans* | DSM 7216 | X | ND |
| (16) *O. tritici* | DSM 13340 | ○ | + |
| (17) LBNL124-A-10 | LBNL | ○ | + |
| (18) HTG3-C-07 | LBNL | ○ | ++ |
| (19) *O. haywardense* H1 | DuPont Pioneer | ○ | +++ |

Example 12 —*Arabidopsis* Transformation

*Ochrobactrum haywardense* H1 NRRL Deposit B-67078 further comprising plasmid PHD4673 as described in Example 3 was inoculated to 50 mL LB liquid medium containing gentamicin 100 mg/L and cultured at 28° C., 250 rpm for 18-24 hrs. *Ochrobactrum haywardense* H1 NRRL Deposit B-67078 further comprising PHD4673 cultures were centrifuged at 4,000 rpm, 20° C. for 15 min and the pellets were resuspended in 75 mL of freshly prepared 5% sucrose with 0.02% (v/v) Silwet L-77 surfactant (Helena Chemical Company 225 Schilling Blvd. Collierville, Tenn. 38017). *Arabidopsis thaliana* Col-0 transformation was carried out using a modified floral dip method (Clough & Bent (1998) Plant J 16:735-743). After floral dip with *Ochrobactrum haywardense* H1 NRRL Deposit B-67078 further comprising PHD4673, the plants were allowed to grow in plant growth chamber at 21° C., 16 hr photoperiod at 60-100 µE/m²/s and seeds were collected after the pods turned to brown. Seeds were surface sterilized under laminar hood with 95% ethanol for 1 minute, 20% bleach plus one drop of Tween-20 for 15 minutes and washed 3 times with the sterile water. 30 mg of sterilized seed were plated on the agar selection medium composed with 1× MS salts with vitamins, 1% sucrose (pH5.7), 0.8% TC Agar, 100 mg/L Timentin and 50 mg/L kanamycin in 150×25 mm petri dishes (Cat#351013, Falcon Large Petri Dishes, VWR). Plates were dried up under laminar flow and sealed with parafilm and were cultured at 21° C. at 16 hour photoperiod at 60-100 µE/m²/s for germination and growth. 9 days after selection on kanamycin 50 mg/L medium, putative events that germinate and green were counted and DsRED expression was observed under the fluorescent microscope. Transformation efficiencies showing kanamycin resistance and DsRED positive germinated seedlings were ranged 0.53-1% and the average transformation efficiencies are 0.77% (Table 15). Kanamycin resistance and DsRED positive germinated seedlings were transplanted to soil for further growth and analysis.

TABLE 15

Transformation efficiencies showing kanamycin resistant and DsRED positive *Arabidopsis* seeds transformed with *Ochrobactrum haywardense* H1 NRRL Deposit B-67078 further comprising PHD4673.

| | Seeds screened | Km resistant + DsRED positive events/plate | Transformation efficiencies (%) |
|---|---|---|---|
| Plate 1 | 1,500 (30 mg) | 8 | 0.53 |
| Plate 2 | 1,500 (30 mg) | 15 | 1.0 |
| Plate 3 | 1,500 (30 mg) | 9 | 0.6 |
| Plate 4 | 1,500 (30 mg) | 14 | 0.93 |
| Total | 6,000 (120 mg) | 46 | 0.77 |

Example 13—Transient Expression in *Sorghum* Leaf Disc

Overnight cultured *Ochrobactrum haywardense* H1 NRRL Deposit B-67078 empty (no vector) and *Ochrobactrum haywardense* H1 NRRL Deposit B-67078 further comprising PHD4674 were centrifuged at 4,000 rpm, 20° C. for 20 min and the pellets were resuspended in 10 mM $MgSO_4$ with 400 µM acetosyringone adjusting cell density closely to 1.0 at OD 600. *Sorghum bicolor* DuPont Pioneer TX430 plants were grown in growth chambers with 16 h light at 375-450 µE/m²/s, 26° C. day and 22° C. night. The infiltration was carried out as described by Kapila et al. (Plant Sci (1997) 122:101-108) and Siehl et al. (Plant Physiol (2014) 166:1162-76.). Leaves of 5-week old sorghum plants were infiltrated with *Ochrobactrum haywardense* H1 NRRL Deposit B-67078 empty and *Ochrobactrum haywardense* H1 NRRL Deposit B-67078 (PHD4674) for transient DsRED expression and examined by Leica fluorescence microscopy at 4 days post infiltration (dpi). The DsRED expression was seen in sorghum leaves infiltrated with *Ochrobactrum haywardense* H1 NRRL Deposit B-67078 further comprising PHD4674 but not from *Ochrobactrum haywardense* H1 NRRL Deposit B-67078 empty. First confirmation of successful DsRED expression was detected at 4 days post infiltration (dpi) via fluorescence microscopy but the quantification was delayed until 7 dpi to allow for further accumulation of gene product. DsRED quantification was performed on all treated samples by GE Typhoon Trio (variable mode imager) GE Healthcare Bio-Sciences, P.O. Box 643065 Pittsburgh, Pa. 15264-3065. Prior to scanning, extracts were filtered for cell debris and normalized by Bradford assay to 150m total soluble protein in final volume of 100 µL CCLR buffer/per measured sample, final scan was then analyzed via ImageQuantTL image analysis software (GE Healthcare Bio-Sciences, P.O. Box 643065 Pittsburgh, Pa. 15264-3065). The averages of relative fluorescent unit from sorghum leaf extract infiltrated with *Ochrobactrum haywardense* H1 NRRL Deposit B-67078 further comprising PHD4674 were 3.5-23 times higher than that of *Ochrobactrum haywardense* H1 NRRL Deposit B-67078 empty. The results clearly showed that *O. haywardense* H1 further comprising PHD4674 can deliver DNA and express in sorghum cells.

TABLE 16

Relative DsRED expression from the extracts of *sorghum* leaves infliterated with *Ochrobactrum haywardense* H1 NRRL Deposit B-67078 empty and *Ochrobactrum haywardense* H1 NRRL Deposit B-67078 further comprising PHD4674. 12-18 leaf samples for the relative fluorescent units were included in each treatment.

| | Treatments | Relative fluorescent units ± Standard deviation |
|---|---|---|
| Experiment 1 | *O. haywardense* H1 empty | 458 ± 1,297 |
| | *O. haywardense* H1 further comprising PHD4674 | 3,875 ± 7,454 |
| | *O. haywardense* H1 further comprising PHD4674 | 10,829 ± 18,494 |
| Experiment 2 | *O. haywardense* H1 empty | 714 ± 2,191 |
| | *O. haywardense* H1 further comprising PHD4674 | 2,502 ± 3,344 |
| | *O. haywardense* H1 further comprising PHD4674 | 4,419 ± 5,045 |
| Experiment 3 | *O. haywardense* H1 empty | 336 ± 2,192 |
| | *O. haywardense* H1 further comprising PHD4674 | 3,705 ± 5,661 |
| | *O. haywardense* H1 further comprising PHD4674 | 3,456 ± 6,338 |

Example 14—Comparison of PHP70365 (Ti Vir Construct) Vs PHP81185 (Ri Vir Construct)

Soybean transformations were carried out as described in Example 10. Transient DsRED expression in the meristem region of the embryonic axis transformed with *Ochrobactrum haywardense* H1 NRRL Deposit B-67078 harboring PHP70365 or PHP81185 was observed 7 days after co-cultivation. The explants infected with both construct showed equal levels of DsRed transient expression. Stably transformed DsRED positive shoots 1-1.5 cm in size were produced in 6-8 weeks after transformation with *Ochrobactrum haywardense* H1 NRRL Deposit B-67078 further comprising PHP70365 or PHP81185. The stable transformation efficiencies with *Ochrobactrum haywardense* H1 NRRL Deposit B-67078 further comprising PHP70365 or PHP81185 were similar as shown in Table 17.

TABLE 17

Stable transformation efficiencies of *Ochrobactrum haywardense* H1 NRRL Deposit B-67078 further comprising PHP70365 (SEQ ID NO: 106) or PHP81185 (SEQ ID NO: 114)

| Construct | No. Explants | No. of Mature Plants (%) |
|---|---|---|
| PHP70365 | 118 | 3 (2.5) |
| PHP81185 | 123 | 3 (2.4) |

Example 15—Comparison of Various Origins of Replicon in Co-Integration and Co-Habitating Vector Systems Co-integration vectors and the combinations of helper and binary vectors as listed in Table 1B and Table 18 were introduced into *Ochrobactrum haywardense* H1 and the red fluorescent protein (RFP) transient expression was carried out using the modified method of tobacco BY-2 suspension cells as described in Example 2. RFP expressions were observed under the Leica fluorescence stereomicroscope 7 days after the infection. Plasmids showing RFP expression in tobacco BY-2 cells are summarized in Table 18.

Co-integration vectors PHP79762 (BBR1 ORI), PHP79767 (PVS1 ORI) and PHP81092 (RK2micro) are isogenic to pVir 8 except for the origin of replication. The origin of replication is indicated in ( ) after each plasmid PHP. These vectors all showed transient RFP expression. All of the above origins of replication were functional for plant transformation.

In the following, regardless of the plasmid PHP number the helper plasmids are isogenic other than the origin of replication. Likewise the binary vectors are isogenic other than the origin of replication. The origin of replication is indicated in ( ) after each plasmid PHP. The following combinations of the co-habitating vector system, (1) the helper plasmid PHP79759 (BBR1 ORI) with binary vectors PHP79763 (BBR1 ORI), RV005199 (PSA ORI), PHP79768 (PVS1 ORI), PHP79766 (repABC), PHP80569 (RK2full), and PHP80404 (RK2full+PARDE), (2) the helper plasmid PHP80402 (PSA ORI) with binary vectors PHP80569 (RK2full), and PHP80404 (RK2full+PARDE), (3) the helper plasmid PHP80399(PSA ORI+PARDE) with binary vectors PHP79768 (PVS1 ORI), PHP79766 (repABC), PHP80569 (RK2full), and PHP80404 (RK2full+PARDE), (4) the helper plasmid PHP79761 (PVS1 ORI) with binary vectors RV005199 (PSA ORI), PHP79768 (PVS1 ORI), PHP79766 (repABC), PHP79764 (RFS1010 ORI), PHP80569 (RK2full), and PHP80404 (RK2full+PARDE), (5) the helper plasmid PHP79760 (RFS1010 ORI) with binary vectors RV005199 (PSA ORI), PHP79768 (PVS1 ORI), PHP79766 (repABC), PHP79764 (RFS1010 ORI), and PHP80404 (RK2full+PARDE), (6) the helper plasmid RV005393 (RK2full+PARDE) with binary vectors RV005199 (PSA ORI), PHP79768 (PVS1 ORI), and PHP79766 (repABC), (7) the helper plasmid PHP80398 (RK2micro) with binary vectors RV005199 (PSA ORI), PHP79766 (repABC), and RV005201 (RK2micro), and (8) the helper plasmid PHP80566 (RK2micro+PARDE) with binary vector PHP79768 (PVS1 ORI) all showed various levels of RFP expression. All of the origins of replication listed above were functional for plant transformation.

TABLE 18

Origin of replicon showing transient RFP expression in tobacco BY-2 cells transformed with *Ochrobactrum haywardense* H1 strain harboring co-integration or co-habitating (helper with binary) vectors. Empty boxes in Table 18 indicate that plasmid component was not present.

| Co-integration | Helper | Binary |
|---|---|---|
| PHP79762 (BBR1 ORI, SEQ ID NO: 112) | | |
| PHP79767 (PVS1 ORI, SEQ ID NO: 3) | | |
| PHP81092 (RK2micro ORI, SEQ ID NO: 54) | | |
| | PHP79759 (BBR1 ORI, SEQ ID NO: 112) | PHP79763 (BBR1 ORI, SEQ ID NO: 112) |
| | PHP79759 (BBR1 ORI, SEQ ID NO: 112) | RV005199 (PSA ORI, SEQ ID NO: 53) |
| | PHP79759 (BBR1 ORI, SEQ ID NO: 112) | PHP79768 (PVS1 ORI, SEQ ID NO: 3) |
| | PHP79759 (BBR1 ORI, SEQ ID NO: 112) | PHP79766 (repABC ORI, SEQ ID NO: 57) |
| | PHP79759 (BBR1 ORI, SEQ ID NO: 112) | PHP80569 (RK2full ORI, SEQ ID NO: 38) |
| | PHP79759 (BBR1 ORI, SEQ ID NO: 112) | PHP80404 (RK2full ORI, SEQ ID 38 + PARDE, SEQ ID NO: 55) |
| | PHP80402 (PSA ORI, SEQ ID NO: 53) | PHP80569 (RK2full ORI, SEQ ID NO: 38) |
| | PHP80402 (PSA ORI, SEQ ID NO: 53) | PHP80404 (RK2full ORI, SEQ ID 38 + PARDE, SEQ ID NO: 55) |
| | PHP80399 (PSA ORI + PARDE, SEQ ID NO: 56) | PHP79768 (PVS1 ORI, SEQ ID NO: 3) |
| | PHP80399 (PSA ORI + PARDE, SEQ ID NO: 56) | PHP79766 (repABC ORI, SEQ ID NO: 57) |
| | PHP80399 (PSA ORI + PARDE, SEQ ID NO: 56) | PHP80569 (RK2full ORI, SEQ ID NO: 38) |
| | PHP80399 (PSA ORI + PARDE, SEQ ID NO: 56) | PHP80404 (RK2full ORI, SEQ ID 38 + PARDE, SEQ ID NO: 55) |
| | PHP79761 (PVS1 ORI, SEQ ID NO: 3) | RV005199 (PSA ORI, SEQ ID NO: 53) |
| | PHP79761 (PVS1 ORI, SEQ ID NO: 3) | PHP79768 (PVS1 ORI, SEQ ID NO: 3) |
| | PHP79761 (PVS1 ORI, SEQ ID NO: 3) | PHP79766 (repABC ORI, SEQ ID NO: 57) |
| | PHP79761 (PVS1 ORI, SEQ ID NO: 3) | PHP79764 (RFS1010 ORI, SEQ ID NO: 37) |
| | PHP79761 (PVS1 ORI, SEQ ID NO: 3) | PHP80569 (RK2full ORI, SEQ ID NO: 38) |
| | PHP79761 (PVS1 ORI, SEQ ID NO: 3) | PHP80404 (RK2full ORI, SEQ ID 38 + PARDE, SEQ ID NO: 55) |
| | PHP79760 (RFS1010 ORI, SEQ ID NO: 37) | RV005199 (PSA ORI, SEQ ID NO: 53) |
| | PHP79760 (RFS1010 ORI, SEQ ID NO: 37) | PHP79768 (PVS1 ORI, SEQ ID NO: 3) |
| | PHP79760 (RFS1010 ORI, SEQ ID NO: 37) | PHP79766 (repABC ORI, SEQ ID NO: 57) |
| | PHP79760 (RFS1010 ORI, SEQ ID NO: 37) | PHP79764 (RFS1010 ORI, SEQ ID NO: 37) |
| | PHP79760 (RFS1010 ORI, SEQ ID NO: 37) | PHP80404 (RK2full ORI, SEQ ID 38 + PARDE, SEQ ID NO: 55) |
| | RV005393 (RK2full ORI, SEQ ID 38 + PARDE, SEQ ID NO: 55) | RV005199 (PSA ORI, SEQ ID NO: 53) |

TABLE 18-continued

Origin of replicon showing transient RFP expression in tobacco BY-2 cells transformed with *Ochrobactrum haywardense* H1 strain harboring co-integration or co-habitating (helper with binary) vectors. Empty boxes in Table 18 indicate that plasmid component was not present.

| Co-integration | Helper | Binary |
|---|---|---|
| | RV005393 (RK2full ORI, SEQ ID 38 + PARDE, SEQ ID NO: 55) | PHP79768 (PVS1 ORI, SEQ ID NO: 3) |
| | RV005393 (RK2full ORI, SEQ ID 38 + PARDE, SEQ ID NO: 55) | PHP79766 (repABC ORI, SEQ ID NO: 57) |
| | PHP80398 (RK2micro ORI, SEQ ID NO: 54) | RV005199 (PSA ORI, SEQ ID NO: 53) |
| | PHP80398 (RK2micro ORI, SEQ ID NO: 54) | PHP79766 (repABC ORI, SEQ ID NO: 57) |
| | PHP80398 (RK2micro ORI, SEQ ID NO: 54) | RV005201 (RK2micro ORI, SEQ ID NO: 54) |
| | PHP80566 (RK2micro ORI, SEQ ID 54 + PARDE, SEQ ID NO: 55) | PHP79768 (PVS1 ORI, SEQ ID NO: 3) |

Example 16: Plant Transformation with *Ochrobactrum*

*Ochrobactrum* transformation may also be used for the genetic improvement of plants. *Ochrobactrum*-mediated random transformation may be used to deliver expression cassettes containing genes of interest on a T-DNA binary vector with or without helper plasmids. Plant material useful in these random transformations may be dicot plants including, but not limited to sunflower, *Arabidopsis*, safflower, soybean, alfalfa, canola, *Brassica*, and cotton or monocot plants including, but not limited to corn, wheat, rice, barley, oats, sorghum, millet, and sugarcane.

Example 17: Site-Specific Integration with *Ochrobactrum*

*Ochrobactrum* transformation as disclosed herein may be used for site specific gene targeting mediated by recombinases. *Ochrobactrum* transformation may be used to create lines containing one or more non-identical recombination sites to provide a target locus. *Ochrobactrum* transformation can then be used for site specific integration (SSI) at the target locus to permit delivery of a transfer cassette containing one or more constructs as described in U.S. Provisional Appln. No. 62/296,639 incorporated herein by reference in its entirety.

Example 18: Nuclease-Mediated Genome Modification with *Ochrobactrum*

*Ochrobactrum* transformation as disclosed herein may be used to make genome modifications mediated by CRISPR-Cas nucleases. Methods of making genome modifications mediated by CRISPR-Cas nucleases are described in WO 2013/141680, US 2014/0068797, and WO 2015/026883, each of which is incorporated herein by reference in its entirety.

Example 19: Alternative Origins of Replication (Ori) with *Ochrobactrum* Transformation for Improving SSI, CRISPR-Cas9 Nuclease and Endonuclease-Mediated Genome Modifications Using Transfer Cassettes and/or Helper Plasmids with Different Origins of Replication

*Ochrobactrum* transformation using vectors with different Oris may be used to improve SSI and CRISPR-Cas9 genome editing. Methods of making genome modifications mediated by CRISPR-Cas nucleases are described in WO 2013/141680, US 2014/0068797, and WO 2015/026883, each of which is incorporated herein by reference in its entirety. Transfer cassettes with different bacterial Oris resulting in varied plasmid copy numbers including, but not limited to RepABC, pRi, pVS1, RK2 can be used to modulate the amount of DNA molecules delivered to plant cell used in SSI and CRISPR-Cas9 genome editing. Alternatively, the transfer cassettes harboring different Oris can be combined with helper plasmids that carry additional virulence genes. These helper plasmids may have different bacterial origins of replication (Table 1B), with varied plasmid copy number.

Example 20: Sequence Identification Numbers (SEQ ID NO:)

TABLE 19

| SEQ ID NO: | Description |
|---|---|
| 1 | aacC1 gene; *Pseudomonas aeruginosa* |
| 2 | ColE1 ori; *Escherichia coli* |
| 3 | pVS1 ori; *Pseudomonas aeruginosa* |
| 4 | VirB1; *Agrobacterium tumefaciens* |
| 5 | VirB2; *Agrobacterium tumefaciens* |
| 6 | VirB3; *Agrobacterium tumefaciens* |
| 7 | VirB4; *Agrobacterium tumefaciens* |
| 8 | VirB5; *Agrobacterium tumefaciens* |
| 9 | VirB6; *Agrobacterium tumefaciens* |
| 10 | VirB7; *Agrobacterium tumefaciens* |
| 11 | VirB8; *Agrobacterium tumefaciens* |
| 12 | VirB9; *Agrobacterium tumefaciens* |
| 13 | VirB10; *Agrobacterium tumefaciens* |
| 14 | VirB11; *Agrobacterium tumefaciens* |
| 15 | VirG; *Agrobacterium tumefaciens* |

TABLE 19-continued

| SEQ ID NO: | Description |
|---|---|
| 16 | VirC1; *Agrobacterium tumefaciens* |
| 17 | VirC2; *Agrobacterium tumefaciens* |
| 18 | VirD1; *Agrobacterium tumefaciens* |
| 19 | VirD2; *Agrobacterium tumefaciens* |
| 20 | VirD3; *Agrobacterium tumefaciens* |
| 21 | VirD4; *Agrobacterium tumefaciens* |
| 22 | VirD5; *Agrobacterium tumefaciens* |
| 23 | VirE1; *Agrobacterium tumefaciens* |
| 24 | VirE2; *Agrobacterium tumefaciens* |
| 25 | VirE3; *Agrobacterium tumefaciens* |
| 26 | VirA; *Agrobacterium tumefaciens* |
| 27 | VirJ; *Agrobacterium tumefaciens* |
| 28 | PHP45981 |
| 29 | PHP64484 |
| 30 | ZmUbiPro |
| 31 | DsRED; DNA; *Discosoma* sp. |
| 32 | FRT1; *Saccharomyces cerevisiae* |
| 33 | FRT87; DNA; *Saccharomyces cerevisiae* |
| 34 | pVIR7; PHP70298 |
| 35 | pVIR9; PHP71539 |
| 36 | pVIR10; PHP79761; DNA; Artificial sequence |
| 37 | pRFS1010 ori; *Escherichia coli* |
| 38 | pRK2 ori; *Escherichia coli* |
| 39 | aadA selection cassette; *Escherichia coli* |
| 40 | npt1 selection cassette; *Escherichia coli* |
| 41 | npt2 selection cassette; *Escherichia coli* |
| 42 | VirH; *Agrobacterium tumefaciens* |
| 43 | VirH1; *Agrobacterium tumefaciens* |
| 44 | VirH2; *Agrobacterium tumefaciens* |
| 45 | VirK; *Agrobacterium tumefaciens* |
| 46 | VirL; *Agrobacterium tumefaciens* |
| 47 | VirM; *Agrobacterium tumefaciens* |
| 48 | VirP; *Agrobacterium tumefaciens* |
| 49 | VirQ; *Agrobacterium tumefaciens* |
| 50 | pSC101 ori; *Salmonella tymphimurium* |
| 51 | p15A ori, *Escherichia coli* |
| 52 | R6K ori gamma pir; *Escherichia coli* |
| 53 | pSa repA ori; *Escherichia coli* |
| 54 | pRK2 micro; *Escherichia coli* |
| 55 | PARDE; *Escherichia coli* |
| 56 | pSaPARDE; Artificial sequence |
| 57 | repABC-pRi1724; *Agrobacterium rhizogenes* |
| 58 | repABC-pTi-SAKURA; *Agrobacterium tumefaciens* |
| 59 | repABC; PR1b plasmid, *Ruegeria* sp. |
| 60 | repABC; pNGR234, *Sinorhizobium fredii* |
| 61 | pSB1 32 bp palindrome |
| 62 | pSB1 142 bp inverted repeat |
| 63 | pSB1 tra-trb region |
| 64 | trfA; *Escherichia coli* |
| 65 | oriV; *Escherichia coli* |
| 66 | pRK2 mini (oriV-nptIII-trfA); *Escherichia coli* |
| 67 | hpt selection cassette; *Escherichia coli* |
| 68 | UBI-ZMPRO: MO-PAT: PROTEIN LINKER: DS-RED: PINII; DNA; Artifical sequence |
| 69 | pPHP80561; DNA; Artifical sequence |
| 70 | pPHP80559 |
| 71 | pPHP79066 |
| 72 | pPHP78147 |
| 73 | pPHP78148 |
| 74 | pPHP79366 |
| 75 | pPHP60577 |
| 76 | pPHP44542 |
| 77 | SpcN; *Streptomyces spectabilis* |
| 78 | aph; *Legionella pneumophila* |
| 79 | AR-VIRA; *Agrobacterium rhizogenes* |
| 80 | AR-VIRB1; *Agrobacterium rhizogenes* |
| 81 | AR-VIRB2; *Agrobacterium rhizogenes* |
| 82 | AR-VIRB3; *Agrobacterium rhizogenes* |
| 83 | AR-VIRB4; *Agrobacterium rhizogenes* |
| 84 | AR-VIRB5; *Agrobacterium rhizogenes* |
| 85 | AR-VIRB6; *Agrobacterium rhizogenes* |
| 86 | AR-VIRB7; *Agrobacterium rhizogenes* |
| 87 | AR-VIRB8; *Agrobacterium rhizogenes* |
| 88 | AR-VIRB9; *Agrobacterium rhizogenes* |
| 89 | AR-VIRB10; *Agrobacterium rhizogenes* |
| 90 | AR-VIRB11; *Agrobacterium rhizogenes* |
| 91 | AR-VIRG; *Agrobacterium rhizogenes* |
| 92 | AR-VIRC1; *Agrobacterium rhizogenes* |
| 93 | AR-VIRC2; *Agrobacterium rhizogenes* |
| 94 | AR-VIRD1; *Agrobacterium rhizogenes* |
| 95 | AR-VIRD2; *Agrobacterium rhizogenes* |
| 96 | AR-VIRD3; *Agrobacterium rhizogenes* |
| 97 | AR-VIRD4; *Agrobacterium rhizogenes* |
| 98 | AR-VIRD5; *Agrobacterium rhizogenes* |
| 99 | AR-VIRF; *Agrobacterium rhizogenes* |
| 100 | AR-VIRE3; *Agrobacterium rhizogenes* |
| 101 | AR-GALLS; *Agrobacterium rhizogenes* |
| 102 | S rDNA forward primer |
| 103 | S rDNA reverse primer |
| 104 | EP1A09 16S rDNA |
| 105 | EP1A09 16S rDNA 1318 bp |
| 106 | PHP70365; pVIR8 |
| 107 | PHD5261 |
| 108 | PHP79768 |
| 109 | PHP72277 |
| 110 | PHD4673 |
| 111 | PHD4674 |
| 112 | BBR1 origin; *Bordetella* |

TABLE 19-continued

| SEQ ID NO: | Description |
|---|---|
| | bronchiseptica |
| 113 | RV013684 |
| 114 | PHP81185 |

DEPOSIT

In some aspects the bacterial strain is a biologically pure culture of a *Ochrobactrum haywardense* H1 strain, deposited on Jul. 10, 2015 under Accession Number NRRL B-67078 with the Agricultural Research Service Culture Collection (NRRL), 1815 North University Street, Peoria, Ill. 61604, (nrrl.ncaur.usda.gov, which can be accessed on the world-wide web using the "www" prefix). The deposit will be maintained under the terms of the Budapest Treaty on the International Recognition of the Deposit of Microorganisms for the Purposes of Patent Procedure. These deposits were made merely as a convenience for those of skill in the art and are not an admission that a deposit is required under 35 U.S.C. § 112. Access to this deposit will be available during the pendency of the application to the Commissioner of Patents and Trademarks and persons determined by the Commissioner to be entitled thereto upon request. Upon allowance of any claims in the application, the Applicant(s) will make available to the public, pursuant to 37 C.F.R. § 1.808, sample(s) of the deposit of with the Agricultural Research Service Culture Collection (NRRL), 1815 North University Street, Peoria, Ill. 61604. This deposit will be maintained in the NRRL depository, which is a public depository, for a period of 30 years, or 5 years after the most recent request, or for the enforceable life of the patent, whichever is longer, and will be replaced if it becomes nonviable during that period. The deposits will irrevocably and without restriction or condition be available to the public upon issuance of a patent. Additionally, Applicant(s) have satisfied all the requirements of 37 C.F.R. §§ 1.801-1.809, including providing an indication of the viability of the sample upon deposit. Applicant(s) have no authority to waive any restrictions imposed by law on the transfer of biological material or its transportation in commerce. Applicant(s) do not waive any infringement of their rights granted under this patent. However, it should be understood that the availability of a deposit does not constitute a license to practice the subject disclosure in derogation of patent rights granted by government action.

As used herein the singular forms "a", "an", and "the" include plural referents unless the context clearly dictates otherwise. Thus, for example, reference to "a cell" includes a plurality of such cells and reference to "the protein" includes reference to one or more proteins and equivalents thereof known to those skilled in the art, and so forth. All technical and scientific terms used herein have the same meaning as commonly understood to one of ordinary skill in the art to which this disclosure belongs unless clearly indicated otherwise.

All publications, patents, patent applications, or other documents cited in this application are incorporated by reference in their entirety for all purposes to the same extent as if each individual publication, patent, patent application, or other document were individually indicated to be incorporated by reference in its entirety for all purposes. While the foregoing invention has been described in some detail for purposes of clarity and understanding, it will be clear to one skilled in the art from a reading of this disclosure that various changes in form and detail can be made without departing from the true scope of the invention. For example, all the techniques, methods, compositions, apparatus and systems described above may be used in various combinations. Although the foregoing disclosure has been described in some detail by way of illustration and example for purposes of clarity of understanding, certain changes and modifications may be practiced within the scope of the appended claims.

SEQUENCE LISTING (114 sequences)

SEQ ID NO: 1 - DNA, 534 bp, Pseudomonas aeruginosa
atgttacgcagcagcaacgatgttacgcagcagggcagtcgccctaaaacaaagttaggtggctcaagtatgggcatcattcgcacatgtaggctcggccctgaccaagtcaaatccatgcgggctgctcttgatcttttcggtcgtgagttcggagacgtagccacctactcccaacatcagccggactccgattacctcgggaacttgctccgtagtaagacattcatcgcgcttgctgccttcgaccaagaagcggttgttggcgctctcgcggcttacgttctgcccaagtttgagcagccgcgtagtgagatctatatctatgatctcgcagtctccggcgagcaccggaggcagggcattgccaccgcgctcatcaatctcctcaagcatgaggccaacgcgcttggtgcttatgtgatctacgtgcaagcagattacggtgacgatcccgcagtggctctctatacaaagttgggcatacgggaagaagtgatgcactttgatatcgacccaagtaccgccacctaa

SEQ ID NO: 2 - DNA, 1221 bp, Escherichia coli
gaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagc

SEQ ID NO: 3 - DNA, 2559 bp, Pseudomonas aeruginosa
taaaacagcttgcgtcatgcggtcgctgcgtatatgatgcgatgagtaaataaacaaatacgcaaggggaacgcatgaaggttatcgctgtacttaaccagaaaggcgggtcaggcaagacgaccatcgcaacccatctagcccgcgccctgcaactcgccggggccgatgttctgttagtcgattccgatccccagggcagtgcccgcgattgggcggccgtgcgggaagatcaaccgctaaccgttgtcggcatcgaccgcccgacgattgaccgcgacgtgaaggccatcggccggcgcgacttcgtagtgatcgacggagcgccccaggcggcggacttggctgtgtccgcgatcaaggcagccgacttcgtgctgattccggtgcagccaagcccttacgacatatgggccaccgccgacctggtggagctggttaagcagcgcattgaggtcacggatggaaggctacaagcggcctttgtcgtgtcgcgggcgatcaaaggcacgcgcatcggcggtgaggttgccgaggcgctggccgggtacgagctgcccattcttgagtcccgtatcacgcagcgcgtgagctacccaggcactgccgccgccggcacaaccgttcttgaatcagaacccgagggcgacgctgcccgcgaggtccaggcgctggccgctgaaattaaatcaaaactcatttgagttaatgaggtaaagagaaaatgagcaaaagcacaaacacgctaagtgccggccgtccgagcgcacgcagcagcaaggctgcaacgttggccagcctcgcagacacgccagccatgaagcgggtcaactttcagttgccggcggaggatcacaccaagctgaagatgtacgcggtacgccaaggcaagaccattaccgagctgctatctgaatacatcgcgcagctaccagagtaaatgagcaaatgaataaatgagtagatgaattttagcggctaaaggaggcggcatggaaaatcaagaacaaccaggcaccgacgccgtggaatgccccatgtgtggaggaacgggcggttggccaggcgtaagcggctgggttgcctgccggccctgcaatggcactggaacccccaagcccgaggaatcggcgtgagcggtcgcaaaccatccggcccggtacaaatcggcgcggcgctgggtgatgacctggtggagaagttgaaggcagcgcaggccgcccagcggcaacgcatcgaggcagaagcacgccccggtgaatcgtggcaagcagccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggcaggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctagctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagccgaagagctgcaaaaagcgcctacccttcggtcgctgcgctccctacgccccgccgcttcgcgtcggcctat

SEQ ID NO: 4 - DNA, 720 bp, Agrobacterium tumefaciens
atgcttaagagatcggggtcgctttctcttgccttgatggtctccttctgttcgtcgagccttgccacgccactctcatctgctgagtttgaccatgttgctcgcaagtgtgccccatcagttgcgacatctacgcttgcggcgatagctaaggtggagagtcgctttgatcctttagcgattcatgacaacacgaccggcgaaacgcttcactggcaagatcacagccaagcaacccaagtcgtcaggcaccgtctcgatgcacggcattcgctggatgttggcctcatgcaaataaactctcgaaatttttctatgctcggtctgacacctgacggtgcgctccaggcgtgcacatcattatctgccgctgcaaacatgctgaaaagtcgttatgcaggcggcgaaacgattgacgagaagcaatttgcgcttcgtcgggcgatctccgcttacaacaccggtaatttcatcggcggttttgcaaacggctacgtgcgaaaagttgaaacagctgctcaatcgctggtgcccgcgttaatcgagcctccaaaagacgatcacgaggcgctaaaatccgaagagacgtgggatgtttgggggtcatatcagcgccgctcgcaggaggatggcgctggcggtttaatcgctccgccaccgccacaccaggacaacggcaaatccgcagacgacaatcaagtcttattcgacttatactaa

SEQ ID NO: 5 - DNA, 365 bp, Agrobacterium tumefaciens
atgcgatgctttgagagataccgtttacatctaaatcgcctctcgctctcgaatgcgatgatgcgcgtgatatcgagctgcgccccaagcttgtgcggtgcaattgcatggagcatttcctcatccggacccgccgcagcgcaatctgcgggtggcggcactgaccccgccacaatggttaacaatatatgcacgtttatccttggtccgttcggccagtcactcgctgttctcggcattgtcgctatcgggatctcctggatgttcgggcgggcttcgcttgggctggttgccggcgtcgtcggcggcattgttatcatgtttggggcgagcttcctcggccaaacgctcactggcggtagttg

SEQ ID NO: 6 - DNA, 326 bp, Agrobacterium tumefaciens
atggctgatcgtttggaagaatcgaccctttacctcgcagccacacggcccgcattgtttcttggggtgccactgacattggcagggttattcatgatgttcgccggctttgtcatcgttatcgttcagaacccgctctacgaagtcgttctcgtgccgttatggtttgcagcccggctcatcgtggagcgagactacaatgcggcgagcgtcgtcctgctatttttgcggaccgcgggaagaagcattgatagtgcagtttgggggggcgctactgttagcccaaatccaattagggttcccccacgagggagaggaatggtgtg

SEQ ID NO: 7 - DNA, 2370 bp, Agrobacterium tumefaciens
atgctcggcgcgagtggaacgaccgaaagatccggtgagatctatctcccttatattggccacctcagcgaccatatcgtccttcttgaagacggatcgatcatgaccattgcgagaattgatggcgttgcattcgagcttgaggaaactgaaatgcgcaatgcgcgttgtcgtgcgttcaacacgctgttgcgcaatatcgctgatgatcatgtgtcaatatatgctcacctcgtacgtcatgccgacgtgccatcatcggcgccgcgacacttccgtagtgttttcgccgctagcctgaacgaagcttttgaacagcgcgtgctctccggccaactcctccgcaatgaacacttccttacgttgattgtctacccacaggcggctttagggaaggtaaagaggaggttcaccaagctaagcggaaaaagggaaaacgatctcacgggccagatcaggaacatggaagatctttggcatgttgtcgctggctctcttaaagcgtatggcctgcatcgtcttggcatccgcgagaagcagggtgtgctcttcaccgaaattggcgaagcgctacggttgatcatgactggtcggttcacaccggttccggtcgtcagcggctcactcggcgcttcgatttataccgacagagtcatttgcggcaagcgaggactcgagatcagaacgccaaaagacagttacgttggatccatctattcgtttcgcgaataccctgcaaaaacacggccgggcatgctcaacgcgctgctatccctcgattttccacttgttctcacgcagagtttttcgttcctgactcgcccgcaagcgcacgcgaaacttagcctcaaatcgagccagatgctgagttccggcgataaagccgtgactcaaatcggcaaattatccgaggctgaggacgcacttgcgagcaacgaattcgttatgggctcacatcatttgagcctttgcgtctatgcagacgatctcaatagtcttggggacaggggcgcgcgggctcggacacgaatggcggatgcaggtgccgtggttgtccaagaaggtattggtatggaagcggcctattggtcccaattgccggggaattttaagtggcgcacacgccctggcgcaatcacttcacgcaatttcgcagggtttgtctctttcgaaaactttccagagggcgccagctcaggccactggggcaacgcgattgcccgatttcgtaccaatggcggaacgcctttcgactatatcccgcatgagcacgatgttggcatgacggcaatattcgggcctatcgggaggggtaagacgacgctcatgatgtttgttctagccatgctcgaacagagcatggtcgaccgtgcaggtacggtcgtgttctttgacaaggaccggggtggcgaattgctggttcgcgccacaggaggaacatatttggcacttcacagaggcacacccagcgggttggcgccgttgcgtggcctagaaaacacagcagcctcacacgattttctgcgcgaatggatcgtggctctcatcgagagtgatggtcggggtgggatttctccggaagagaaccgccgtctggtccgtggtatccatcgtcagctctcgtttgatccacaaatgcgttcaatcgcggggttacgtgaatttttgttgcatgggcccgccgaaggcgcaggagcgcggctccaacgctggtgccggggccatgcgcttggctgggcatttgacggcgaagttgacgaagtaaagttagatccgtcgattaccggcttcgacatgacgcatcttctcgaatacgaggaagtatgcgctcccgctgcagcatatctcctgcatcggattggagccatgatcgacggccgccgttttgtgatgagctgcgatgagtttcgcgcctatttgttaaaccctaaattttcgactgtcgtcgacaaattcctcctgaccgttcgaaaaaacaacgggatgctaatactggcaacgcagcaaccagagcatgttctggaatcgccgctaggagccagcttggttgcgcaatgtatgacgaagattttctatccatcaccaaccgcagatcgatcggcttatgtcgatggactgaaatgtaccgaaaaggaatttcaggcgatccgtgaagacatgacggtcggcagccgtaagtttcttcttaaacgagaaagtggaagcgtcatctgcgaatttgatctgcgggatatgcgtgaatatgtcgccgtgctttcggggcgtgccaacacggtgcgctttgcaactcgactacgcgaggcacaagaaggcaactcatctggctggctcagcgaattcatggcccgtcaccacgaggcagaagattga

SEQ ID NO: 8 - DNA, 663 bp, Agrobacterium tumefaciens
atgaagacgacgcaacttattgcaacagttttgacctgcagctttctatatattcagcccgcgcgggcgcagtttgttgttagcgacccggcaacggaggctgagacgctcgcgactgcgctcgcgactgcggagaatctcactcagactatagcgatggttacgatgttgacgtcggcctacggcgttactggactactgacttcgctcaaccagaaaaatcagtatccttcgacgaaggacctagacaatgaaatgttttcgccgcgaatgccaatgtcgaccacggcacgtgcgatcaccagcgatacagatcgtgcagtcgtgggtagtgatgctgaagcggacctgttgcgatcgcagatcaccggttccgcaaacagcgctggcattgcggctgacaatctggaaacgatggacaaacgcttgacggcgaatgctgatacgtctgctcagctttcccgatctcgcaatatcatgcaggcaaccgtgaccaatggtttgcttctcaagcagatccatgacgcaatgattcaaaatgtacaggcgacaagcctattaacgatgactaccgcgcaggccggccttcacgaggcggaagaggcggccgctcaacgcaaggagcatcaaaagaccgctgtcatctttggtgccctcccctaa

SEQ ID NO: 9 - DNA, 888 bp, Agrobacterium tumefaciens
atgaatttcacgattccggcgccgtttacggccattcatacgatcttcgatgtagccttcacgacaggcttggactcgatgcttgagactatccaggaggcggtgagtgcgccattgatcgcctgtgtcactctttggattattgttcagggtattttagtcatacgcggcgaagtcgatacccgtagcggtatcactcgggtgatcacggtcaccatcgttgttgctctaattgttgggcaggctaactaccaagactatgtggtttccatcttcgaaaagacggtcccaaactttgttcagcagtttagtgtaaccggcttgcctctgcagactgttccggcacagttggatacaatgttcgccgtgacccaggccgtttttcagaaaatcgcatccgaaatcggtccgatgaacgaccaggacatccttgctttccaaggggcacagtgggtcctttacggcacgctctggtctgccttcggagtttacgacgccgttggaattctcacgaaagtgcttctcgcgatcgggcctctgatcctcgtcggatatatttttgatcgcacgcgggacatcgcagctaagtggatcgggcaacttatcacctacggtctcttgcttctcctcttaaacctcgtggcaacgatcgtcatcctaaccgaagcgactgcgctcacccttatgcttggtgtaatcaccttcgccggtacgaccgcggccaagatcattggtctttacgaactcgatatgttttttctgacaggggatgcgctcattgtcgctttgccggcgatcgccggcaacattggaggcagttactggagcggcgcaacccaatctgccagcagcttgtaccgtcgcttcgctcaggttgagcgaggctag

SEQ ID NO: 10 - DNA, 154 bp, Agrobacterium tumefaciens
atgaagtattgcctgctgtgcctagttgtcgctttgagcggctgccagacaaacgacacattagcgagctgcaaaggcccgatcttcccgctgaatgtggggcgatggcagcctactccgtcagatcttcagctcggcaattcgggtggacgct

SEQ ID NO: 11 - DNA, 710 bp, Agrobacterium tumefaciens
atgacggggcctgaatatgccatgctagtggcgcgcgaaagccttgccgagcactataaggaagtagaagcctttcaaaccgcgcgagcgaaatcggcgcgacgtctctccaaactcattgcagctgtcgcagctatcgcgattttgggaaatgttgctcaagcgttcgctatagccacaatggtgccgttgagcaggcttgtgcccgtatatctatggatacggccggacggcaccgttgacagcgaggtgtctgtctcgcgattgcctgcaactcaagaggaggccgtcgttaacgcctcattgtgggagtacgttcgcctgcgcgagagttatgatgccgacaccgctcagtacgcctacgacctggtatcgaacttcagtgccccaacagtgcgccaggattaccagcaattcttcaactatcccaatcccagttcgcctcaagtcattcttggcaaacgcggcagggtggaggtcgagcacatcgcttcaaatgatgtaactccaagcacgcagcaaattcgctataaaaggaccctcgtcgttgacggcaaaatgcctgtggtgagtacgtggaccgcgacagttcgctacgaaaaggtgaccagcttgcccggcagattgagactaaccaacccggcaggtctggttgtcacctcctatcagacatcggaagataccgtttcaaacgtaggccacagcgaacc

SEQ ID NO: 12 - DNA, 878 bp, Agrobacterium tumefaciens
atgatcagaaaagcacttttcattttagcatgtttatttgccgctgcgactggtgcggaggctgaagacactccaatggcgggcaagctagatccgcgcatgcgttatttggcttacaatcccgatcaagtggtgcgcctctcgacggcggttggagctactttggtcgtaacattcgccacgaacgaaacggtgacagcggttgccgtttcaaatagcaaagatctagcagccctaccgcggggaaattatctatttttcaaggcaagccaggtcctcacgcctcagccagtaatcgtgctaaccgcaagcgactccgggatgcgccgttatgttttcagtataagttccaagactctgtcccacctcgataaagagcagcccgatctctattacagcgtccaattcgcctaccccgccgacgatgcggcggctcggcgaagggaggcacaacagaaggctgttgtggacagactacacgcggaagcacaatatcaacggaaagctgagaatttattggatcagcctgtcacagcccttggtgcggcggacagtaattggcactacgtcgcccaaggcgatcgttcgctgttgccactcgaagtcttcgacaatggatttacgacggtattccactttccgggcaatgtacgcataccctccatctacaccatcaatcctgatggcaaggaagctgttgccaactattcagttaaagggagcgatgtcgagatttcttcggtttcccgaggttggcgtctgagggatggccacacagtactatgtatctggaacaccgcttacgatcccgttggccaaaggccgcaaacgggcacggtgaggcccgatgtgaaacgcgtcctgaagggggcgaaggg

SEQ ID NO: 13 - DNA, 1134 bp, Agrobacterium tumefaciens
atgaataacgatagtcagcaagcggcacatgaggttgatgcatctggatccctggtctccgacaaacatcgccggcgtctttcggggtctcagaaattgatcgtcggaggtgtcgttctcgcgttatcattaagcctcatttggctaggtgggcgccaaaagaaggtgaatgagaacgcatcgccgtcaactttgatcgcaacaaacaccaagccatttcatccagctccgattgaggtgccgccggatcctccagcggttcaagaggctgttcagcctgctgctcctctaccgccgaggggcgaaccggagcggcatgagccacggccggaagaaacaccgatttttgcatatagcagcggcgatcaaggggtcagcaaacgcgccattcagggcgacacgggccgaagacaagaaggcaagcgtgacgacaactccttgccgaatggcgaagtgtccggcgagaacgatttgtcgatacgtatgaaacccaccgagctgcagcccagcagcgccacgctcttgccgcaccccgattttatggtaacgcaagggacaataattccgtgcatcttgcaaaccgcaatcgacacaaatttggcaggctatgtaaagtgtgtcttgcctcaggatattcgtggaacaacgaacaatatcgtgcttcttgatcgtggcaccaccgttgttggcgaaatacagcgtggcttgcaacagggagatgggcgcgtttttgtgttgtgggatcgcgccgagacacctgaccatgcgatgatctcgttaacatcgccaagcgcggacgaactcggtcgctcaggattgccgggctcggtcgacagccacttctggcagcgttttagcggagctatgctcttgagtgttgttcaaggcgccttccaggcagctagcacctacgccggcagctcgggtggcgggatgagcttcaacagctttcaaaataacggtgagcagacaactgagacagcccttaaggcaaccatcaacataccgccaaccctgaagaagaatcagggtgacaccgtttccattttcgtagcacgggacctcgatttctttggtgtttaccagctccgcctgactggcggcgccacgcgggggaggaaccgccgctcttaa

SEQ ID NO: 14 - DNA, 1032 bp, Agrobacterium tumefaciens
atggaagtggatccgcaactacgctttcttctgaagccgattttggaatggctcgatgacccgaagactgaagaaattgcgatcaatcgacctggagaggcatttgtgcgccaagccggcatttttaccaagatgcctttgcccgtctcttatgatgatcttgaagatatcgctattttagcgggcgcgctgagaaagcaggatgtcggaccacgtaaccccctctgcgccactgaacttcctggtggtgaacgactacaaatctgtctgccgccgaccgttccctcgggcaccgtcagcttgaccattcgacggccaagctcgcgtgtttctggtcttaaagaagtctcctcccgttatgatgcttcgaggtggaaccagtggcagacacgaaggaaacgccaaaatcaggatgatgaagctatccttcagcattttgacaacggggatttggaagcgtttctgcacgcatgcgtcgtcagccgactgacgatgttgctatgtggccctaccggaagcggcaagacaacaatgagcaagaccttgatcagcgccatccccccccaggaaaggctaatcaccatagaagatacgctcgaactcgtcattccacacgataatcatgttagactactctactccaagaacggtgctgggctgggtgctgtgagcgccgagcacttgctccaagcaagtctgcgtatgcggccggaccggatattgcttggcgagatgcgcgacgatgcagcatgggcttatctgagtgaagtcgtctcgggacatccgggatcgatttcaacaatacacggcgcgaatccaatccaaggattcaagaaactgttttcccttgtcaaaagtagcgcccaaggtgctagcttggaagatcgcacactgattgacatgctctctacggcgatcgatgtcatcattccattccgtgcctatgaggacgtttatgaagtaggcgagatctggctcgcggcggacgcacgacgccggggcgagaccataggcgatctccttaatcaatag

SEQ ID NO: 15 - DNA, 804 bp, Agrobacterium tumefaciens
atgattgtacatccttcacgtgaaaatttctcaagcgctgtgaacaagggttcagattttagattgagaggtgagccgttgaaacacgttcttcttatcgatgacgatgtcgctatgcggcatcttattatcgaataccttacgatccacgccttcaaagtgaccgcggtagccgacagcacccagttcactagagtactctcttccgcgacggtcgatgtcgtggttgttgatctaaatttaggtcgtgaagatgggcttgagatcgttcgaaatctggcggcaaagtctgatattccaatcataattatcagtggcgaccgccttgaggagacggataaagttgttgcactcgagctaggagcaagtgattttatcgctaagccgtttagtacgagagagtttcttgcacgcattcgggttgccttgcgcgtgcgccccaacgttgtccgctccaaagaccgacggtctttttgttttactgactggacacttaatctcaggcaacgtcgcttgatgtccgaagctggcggtgaggtgaaacttacggcaggtgagttcaatcttctcctcgcgtttttagagaaaccccgcgacgttctatcgcgcgagcaacttctcattgccagtcgagtacgcgacgaggaggtttacgacaggagtatagatgttctcattttgcggctgcgccgcaaacttgaggcggatccgtcaagccctcaactgataaaaacagcaagaggtgccggttatttctttgacgcggacgtgcaggtttcgcacggggggacgatggcagcctga

SEQ ID NO: 16 - DNA, 696 bp, Agrobacterium tumefaciens
atgcaacttttgacgttttgttctttcaaagggggtgctggcaaaaccaccgcactcatgggcctttgcgctgctttggcaaatgacggtaaacgagtggccctctttgatgccgacgaaaaccggcctctgacgcgatggagagaaaacgccttacaaagcagtacctgggatcctcgctgtgaagtctattccgccgacgaaatgccccttcttgaagcagcctatgaaaatgccgagctcgaaggatttgattatgcgttggccgatacgcgtggcggctcgagcgagctcaacaacacaatcatcgctagctcaaacctgcttctgatccccaccatgctaacgccgctcgacatcgatgaggcactatctacctaccgctacgtcatcgagctgctgttgagtgaaaatttggcaattcctacagctgttttgcgccaacgcgtcccggtcggccgattgacaacatcgcaacgcaggatgtcagagacgctagagagccttccagttgtaccgtctcccatgcatgaaagagatgcatttgccgcgatgaaagaacgcggcatgttgcatcttacattactaaacacgggaactgatccgacgatgcgcctcatagagaggaatcttcggattgcgatggaggaagtcgtggtcatttcgaaactgatcagcaaaatcttggaggcttga

SEQ ID NO: 17 - DNA, 609 bp, Agrobacterium tumefaciens
atggcaattcgcaagcccgcattgtcggtcggcgaagcacggcggcttgctggtgctcgacccgagatccaccatcccaacccgacacttgttccccagaagctggacctccagcacttgcctgaaaaagccgacgagaaagaccagcaacgtgagcctctcgtcgccgatcacatttacagtcccgatcgacaacttaagctaactgtggatgcccttagtccacctccgtccccgaaaaagctccaggtttttctttcagcgcgaccgcccgcgcctcaagtgtcgaaaacatatgacaacctcgttcggcaatacagtccctcgaagtcgctacaaatgattttaaggcgcgcgttggacgatttcgaaagcatgctggcagatggatcatttcgcgtggccccgaaaagttatccgatcccttcaactacagaaaaatccgttctcgttcagacctcacgcatgttcccggttgcgttgctcgaggtcgctcgaagtcattttgatccgttggggttggagaccgctcgagctttcggccacaagctggctaccgccgcgctcgcgtcattctttgctggagagaagccatcgagcaattggtga

SEQ ID NO: 18 - DNA, 444 bp, Agrobacterium tumefaciens
atgtcaaaacacaccagagccacgtcgagtgagactaccatcaaccagcatcgatccctgaaagttgaagggttcaaggtcgtgagtgcccgtctgcgatcggccgagtatgaaaccttttcctatcaagcgcgcctgctgggactttcggatagtatggcaattcgcgttgcggtgcgccgcatcgggggctttctcgaaatagatgcagacacacgagaaaagatggaagccatacttcagtccatcggaatactctcaagcaatgtatccatgcttctatctgcctacgccgaagaccctcgatcggatctggaggctgtgcgagatgaacgtattgcttttggcgaggctttcgccgccctcgatggactactgcgctccattttgtccgtatcccggcgacggatcgacggtcgctcgttactgaaaggtgccttgtag

SEQ ID NO: 19 - DNA, 1275 bp, Agrobacterium tumefaciens
atgcccgatcgcgctcaagtaatcattcgcattgtgccaggaggtggaaccaagacccttcagcagataatcaatcagctggagtacctgtcccgaaagggaaagctggaactgcagcgttcagcccggcatctcgatattcccgttccgccggatcaaatccgtgagcttgcccaaagctgggttacggaggccgggatttatgacgaaagtcagtcagacgatgacaggcaacaagacttaacaacacacattattgtaagcttccccgcaggtaccgaccaaaccgcagcttatgaagcaagccgggaatgggcagccgagatgtttgggtcaggatacgggggtggccgctataactatctgacagcctaccacgtcgaccgcgatcatccacatttacatgtcgtggtcaatcgtcgggaacttctggggcaggggtggctgaaaatatccaggcgccatccccagctgaattatgacggcttacggaaaaagatggcagagatttcacttcgtcacggcatagtcctggatgcgacttcgcgagcagaaaggggaatagcagagcgaccaatcacatatgctgaatatcgacgccttgagcggatgcaggctcaaaagattcaattcgaagatacagattttgatgagacctcgcctgaggaagatcgtcgggacctcagtcaatcgttcgatccatttcgatcggacgcatctgccggcgaaccggaccgtgcaacccgacatgacaaacaaccgcttgaaccgcacgcccgtttccaggagcccgccggctccagcatcaaagccgacgcacggatccgcgtaccattggagagcgagcggggtgcccaaccatccgcgtccaaaatccctgtaactgggcatttcgggattgagacttcgtatgtcgctgaagccagcgtgcccaaacaaagcggcaattccgatacttctcgcccggtgactgacgttgccatgcacacagtcgagcgccagcagcgatcaaaacgacgtcatgacgaggaggcaggtccgagcggagcaaaccgtaaaagattgaaggccgcgcaagttgattccgaggcaaatgtcggtgagcccgacggtcgcgatgacagcaacaaggcggctgatccggtgtctgcttccatccgtaccgagcaaccggaagcttctccaacgtgtccgcgtgaccgtcacgatggagaattgggagaacgcaaacgtgcaagaggtaatcgtcgcgacgatgggcgcggggggacctag

SEQ ID NO: 20 - DNA, 635 bp, Agrobacterium tumefaciens
atggcaaatggtcagttcacgatacgctctgctcgcccggcctccgtcggactgacaggcgaacggcgtggagccgcatccgcctctagctctgcactgtccaatgttcaaagagatgttagggataggctgattccaactagctcaccaagattaccaaatgcagccatattgcgtgattcctcgggaagagcgtcgactggtctgcggtacatggcggctactcttcattggtctgcgatcgcgccattatcgctaataaacagcaacgacctggctccggccgcttatgactttgagacgcgaaataacgcaagaaatgtgactgccaaagtcggcagggcagtccctgttcccaagcaaggcgggctcggcaaaacgctcgcacccgtaccccttagtacacgtatatcaagggtcaattccgaccgaagactgcccgctgacgcagaagaccgccctgaaacgcgcgacccccagaaaggacgtggcagtcatggtgcgacgccaaccttacatgaaaagattggaaccgcgtttgctcgaagattgcgaaagcatacgtactatattgtttgcagttgctgccagacccggagcgcgttgacgatgggtgcaaagatttcggtgaagtc

SEQ ID NO: 21 - DNA, 1959 bp, Agrobacterium tumefaciens
atgaactccagcaagacttcgccccagcgtatgaccctgagcatcgtatgttcgctggcagccggtttttgtgcggccagctgctatgtaacgttccgccggggcttcaacggcgaagcgatgatgacgttcgacgttttcgctttttggtatgagaccccgctttacttgggttatgccagcaccgtcttctggcgtggtttatctgttgtcatctttacctcgctgatcgttctttcaagtcagctcatcatatcgctgcgcaatcagaagcatcatgggacagctcgttgggcagaaattggcgaaatgcggcatgctggttatctgcagcgttacagtcgcatcaaggggccgatctttggaaagacatgtggtcccctttggttcggcagttatttgaccaatggcgaacagccacacagtcttgtcgtcgcgccaacgcgtgctggcaaaggcgtcggcatcgtcattccaacgctgttgaccttcaagggctcggtaatcgcccttgacgtcaagggagaattgtttgaactgacgtccagagcacgcaaagcgagcggcgacgcagttttcaagttctcccccctagatcctgagcggaagactcattgttacaatccggtcctggatattgccgcacttccgcccgaacgccagttcactgaaacacgccgtctagctgcgaaccttattacggctaagggaaagggagcagaaggctttattgacggcgcacgtgacctgttcgtcgcgggaatccttacctgcattgagcgtggcacaccaacgattggcgcggtatatgacctatttgcgcagcctggcgaaaagtataagctttttgcgcaactcgcggaggaaagcctaaacaaagaggctcagcgtatcttcgataatatggcgggcaacgacacgaaaattctgacatcgtacacctctgtgctgggcgacggtggactgaacctgtgggctgatccgcttatcaaagcagcgacaagccggtcagacttttccgtttacgatctccggaggaagaagacctgcatttatctttgtgtcagtcccaacgatctggaggtcttggcaccacttatgcgcctgatgtttcagcagctcgtgtcaatcttgcagagatcgctgccaggtgaagacgagtgccatgaagttttatttctcctcgacgaattcaaacacctgggcaagcttgaggccatagagaccgcgatcacaaccatcgccggttacagaggccgctttatgtttattattcaaagtctttcggccttgtcgggcacatacgatgacgcaggaaaacaaaactttctgagcaatactggcgtacaagtatttatggccacggctgatgacgaaactccaacctacatctcaaaagctatcggcgaatatacgtttaaagcgcgttcgacctcttacagtcaagccagaatgttcgaccacaacatccagatttctgatcaaggtgcagcccttttgcgccccgaacaagtgcgcctgctagacgatcagagtgaaatcgttctcatcaaagggcgacctccactcaaattacgaaaggtgcagtattattccgatcgtacgctgaaaggccttttcgaacgccagatgggctctctgcctgagcccgcacccttgatgctttccgactatagcaacgatcaagttcaataccacttggctccgatagcaaattttaatgaggatgctgcaccgcaaaacagaactgtggccgaggaccatggaagtgttaaagtcggtgctgatatccctgaacgcgtgatgggaataaatggtgacgaggaacaagccgatgcgggcgagataccgccggaatcggttgtgcctccagaattgacgctcgctctgaccgctcaacagcaattgttggaccagattattgcacttcagcaaagatcgaggtccgcaccggcatag

SEQ ID NO: 22 - DNA, 2511 bp, Agrobacterium tumefaciens
atgacaggaaagtcgaaagttcacataagaggttcggctgacgcgcttcctgacgttcctggcggaagtactaccgccccttttttaaccgaaccttctcgggatcaggttgatgcctcgtttgaggtccaaaccgactacagccagtctacttccgtgtcgtttacctatgatggtgttggacttggtcctgccgagcgtgcggcttacgagaactggtgcgaaccgggccggcccacttggaaagatcttataatcaaggcacgtgtcgatccgattgacgatgtgacctggctccgagatttagaagaggacaccccctcaaccttcagatacgaagggatgcctctgggcatcggggaacgacaggcctacgaaaattggcaagaggacgctcagccgacatgggaagaccttgttgtcagcgcacgcttgacggaacttggccgtccacacgggattaccggcgagtatacatccctcgcaggatcgaagaatacaagttcaatttcattgaagcgaaagcggagcaacttaattgatgatgagaattcatccggatcgttttcatatgacgggatgaagctcggggaagccgagcgttctgcatatggtgactgggccgaggcggagccacccacgtggaaagatttggtattgagggcacgcgtttcctcgatcaatgactctgcttggctttttgattcacaaacatcttcatcatcatttgaatacaacggtgttcccttgggcgagccggaacggcaggctctcagacaatggcaaggagacgctcagcctacctgggaagatctcgttgttaacgcgcgtatggcagaactttgccatgctggttggattgaaggtcaaaaaggttgctttgaagagcgcggggaggctctgcccgcgtcggaacgcggttcgcaacgccccattggtcaacggacagattcctccgattcttttgtgtatgatggcacaaggctcggagcacctgagcgaactgcttatgaacgctggagtaagagggaacgcccgacttgggaagatctcatcttagatgcacaccaggccaggactgaaagtgacgctgttacgacccaagcgattggtcagtcgtcctcaccggttttcttatatgaaggaaagtcgctcggagacagggaacgaaaggcttacgaaaaatggcggcagccagcccaaccgcgatggcaaaatcttgtagtgaacgctcgtctggcagaaatcgatccctcagcctggattgccgatgagcgcgatccgcttgatgatagcgacgcgcttggtcgcccgtcgtacacaagcttgacggatagatcagacgtccctttagacgatcaatcaatctatcgtcgttccgacctagtaagggagcaggtgccagaatcgtctcaaaggcaattcgcagcatgttcagaatctgaaacgaggcctgtgcaatggtttactgcttctgggtcagatgcaaacaatacggaaaatatcaccgccagcgatcccgtcgatcgcacgggtggagttaagcggctaggctccaaaagcgacagaaccgttacagcttctatccatgacgtgaattccagcacaaggcgactgttgcttaacgaatttggatcggaggctccgcgcccttcgccagaaaagactgttcgcttaagaagcgacaatattggcacctatgggagccggaaaaatgaacgagcgcggctcgcgaccgaaaccggtgcgtatgagtcggagcatattttcgggttcaaggctgtccacgatactgcgagagcgacgaaagagggccggcgtctcgaaaggcccatgcccgcctaccttgaggataaggggcttcatcgccaacatattggcaccgggagaggacggaccaaacttgtcgggcgcggatggccggatgacacaagctatcgctcggatcaaagggcaactctgtcggaccccgttgcgcgctcggaaggcgcgacggcctcaaatgggtatcaattgaaccaattgggttacgcgcaccaactcgctagcgatggcctgcaaagtgaatcgcccgatggtgttgccttgccaattcaagtggcaacaacgagctacaactatacagtgagccgcgatcctgtccttgttccgccggataaaaacgaagcccctcaattgctgcatcttggtccccgtggtcaaaccgaagctgttcttgcccgcgaaacagcattgactggaaaatggccgactctcgagcgtgagcagcaagtgtatcgcgagtttttggccttatatgacgtaaaaaaagatcttgaggccaaatcagtcggcgtaagacggaaaaaaaaagaagttatttctgcgttagaccgaactgcgcgcttgataagcacgtcgccttcgaaagctcgatccaaagcagagactgaaaaagccattgatgagctcgatgatcgacgagtttatgatccgcgtgatcgagctcaagacaaagcgtttaaacgctga

SEQ ID NO: 23 - DNA, 198 bp, Agrobacterium tumefaciens
atggccatcatcaagccgcatgtgaacaaaaataggacaacctcgccgatagagagaccggagtctctcatagaggaaatgagcggcagtcatccgccgagtggttttaccaacctggatctcgctatgatcgagctggaggactttgtccatcggtgcccgctcccagaagacaatcttgctggtcagaaggagtga

SEQ ID NO: 24 - DNA, 1650 bp, Agrobacterium tumefaciens
atggatccgtctagcaatgagaatgtctatgtgggtcgcggtcacaacatcgaaaatgatgatgacactgaccccaggcgttggaagaaggcgaatatcagttccaacaccatctccgatattcagatgacgaatggcgaagacgtacaatcagggagccctacccgaacggaagttgtaagcccacgtctggattatggatcggtcgactcctcctccagcctttattctggcagcgagcacggaaatcaagctgagattcaaaaagagctgtccgtcttgttctcgaacatgtctttgccaggcaacgatcggcgcccggacgaatacattctcgtgcatcaaacgggacaagatgcttttactggtattgccaaaggcaacctcgaccaaatgcccaccaaggcggaatttaacgcgtgctgccgtctctacagggacggagccggtaattactacccgccacctctcgcattcgacaagattagcgttccagagcaactggaggaaaaatgggggatgatggaggcgaaggaacgtaacaaactgcggtttcagtacaagttggacgtatggaatcatgcgcacgctgatatggggatcacgggcacagagatcttttatcaaacagataagaacataaagctcgaccggaattataaactaagacctgaagaccgatacgtacaaacagaaaaatacgggcgccgggaaattcaaaagcgatatcaacacgaactccaggctggttcgctgctgcccgatattatgatcaaaactccccaaaatgacatccacttcgtgtacaggtttgccggcgacaattacgccaacaaacagttcagcgagtttgaacacaccgtcaagcgcaggtatggcgacgagactgagatcaaattgaagtcaaagtcaggcattatgcatgactcgaaatatctggaatcctgggaacggggcagtgcggatattcgcttcgcggaattcgttggggaaaatagagctcacaatcggcagtttccaactgcgacagtaaatatgggacagcagccagacgggcagggcggtttgacccgcgaccgtcatgtgagcgttgacttcctaatgcaaagcgcacccaattcgccttgggcgcaagctttgaaaaagggagaactgtgggatcgcgttcagttgcttgctcgcgacggcaaccgctatctgtcgccgcccagattggaatattctgaccctgcacatttcaccgagttgatgaaccgggttggtttacccgcatcgatgggtcggcaaagccatgcggctagtatcaaattcgaaaagtttgacgcgcaggcagcggttattgtcttaaatggcccagagttacgtgacattcatgacttgtctcctgaaaaactgcaaaatttgtccaccaaagatgtcatcgtcgccgatcgcaatgagaatggtcagagaactggcacgtacaccagcgtcgcggaatatgagcgcttgcagttaaggctgccacccgatgcagcgggggtgcttggtgaagcaactgacaaatattcacgtgatttcgttcggccagagccggcgtcgcgtccaatcagtgacagccgcaggatatacgaaagtcgaccgcgtagccaaagcgtcaacagcttttga

SEQ ID NO: 25 - DNA, 2019 bp, Agrobacterium tumefaciens
atggtgaacactacaaagaaaagttttgcgaagtcgcttacggcagatatgcgccgttctgctcagcgcgttgtcgagcaaatgcgaaaagcattgattaccgaagaagaggcgctcaagcggcaagccagactggagagtcccgataggaagcgaaagtatgctgctgatatggcgatagtcgacaaactcgacgtagggtttcgaggcgaaataggctataaaattcttggaaataaccggcttcgagtagacaaccataaagaattaacgcgtgagcacggtagacttcgcaaaaccaaaacggttctgaagcgtaacccggtgacgcaggaagtctatttgggtttatatgaaaggaagtcctggttaagtgtcagcagccatttgtatgctgcggacggcacactccgcatgaagcacgtgaaatacaaagacggacgttttgaggaaaaatgggagcgcgacgaaaatggcgacctgatccgcacaaggtacgccaaccgtggcaggctctttcaacctgtatccgagaaaatgggcgcgccgtatcggagcggccctgacgaccggctctatcgcgatctaacccgtcgaaacggtttcagacgggagacattcgaacgggacgatcacggaaacctcgagcgtatcggcagcaaccatgtcggcttttccaagatttcagtgaaggcacccaatcgtcaaacctcccagacgaagattcaaaaacttggtggcgctttcaacaaatcttttaggtcccttctggacaaggagggcaatgaaatgggccgcgatattttgagccatcgacggctctataacaagcggtctgctgtctacgatgaagctaccggacaattgaagagtgccaagcataccttcggcaagatctacaggagcgaaaccgaatatctcagcgcgggcctcaagaaggtttcaaaaaagatactcggggtgacggtctaccggaaatttgcggcgctcagcgagcgagaatccgaggctgagagactgcgtagttttgaatccggtgcgcatcgccagatctggcaggagcgggcagcgattcccggttcgcccctcccggagactgatgacattcatttcgcacagcagtcgcacctagccaaagccaaccctgatcacgtcgaagctgacgtcacgcgtgtgacagatcaacatgttgatgttgctggacaaacatcatcgtctccccaacggaacttggaaggatggttagattctcaatcacgatacaagccagcaaacatgctgttgtcaaatccagaccttcaagcgaacggacctcgcccatacgaagggttagctcatctcaccctccggcgcgataatgaatctgacgggcacaaggagaatgatcagcggctgcgacatttctcccagccagagccgttggtgttaccgcatcccgggtcgccggaaataactaaggtgtttggctcgcggggagagccggcacacccgagtggaaatctgcacacggcggttggagaaacggcttgcgaaggaccggtgatgtcttcatcctcggacaatcatcagccagctccaggacagcaagaacttttaagtttccttcataatgcgccagccccagtttctgtggcaatacatgatgatcaagagcgacttgcgggggaggcgcccggcggctctttcagaggtagctcagggcgaacgagttcaatgtcggagagtatcttcgacgaagatgtacaagggcatttggtacgggattattcgatcaatactactaacgggtttattgacccgcaatcgttgttcggtgaaccggacttatcgagaggtccaaaatcggggccagaaattccatcggaagattaccatttgtcagcttcggaacaggaaaatttgctgaatcaattgcttagtgtgccactgccggttccttcaccgaagcccgaatgcgcgaggtctatgattttcgaaggttcacgttcaagagagcgttccacctccagagggttctaa

SEQ ID NO: 26 - DNA, 2490 bp, Agrobacterium tumefaciens
atgaacggaaggtattcaccgacgcggcaggattttaagacaggcgcgaagccttggtctatattagcccttatcgttgccgcaatgattttcgcgttcatggcggttgcgtcctggcaggacaatgggactacccaggcaatccttagccaaatacgatcgattaacgctgacagcgcctcactgcagcgcgatgtactccgcgctcacacgggcaccgtggcgaactaccgccccattatctccaggctgggagctctgcggaagaatctggaagatttgaagcaattatttaggcaatctcatattgtaagtgagagcaatgctgctcaactgctacgccggctagaagtgtctctaaattcggctgacgcggcggtcgccgcctttggtgcgcaaaatgtccgcctgcaagattcgctggccagtttcactcgtgctttaagcaatcttccaggaaaggcctcaggcgatcagactttagaaaaaccaacagaattggctagcatgatgctccaatttcttcggcaaccaagcccggctatttcattcgagatcagccttgaactagagaggctccaaaaacaacgcggtcttgatgaagctcccgtgcgcatactttcgcgtgaaggtcccattatcttatcgcttttgccacaggtgaacgatctggtgaacatgattcagacgtctgacaccgcagaaattgcggaaatgttgcagcgtgagtgtttggaggtctatagcttgaaaaatgtggaggagcggagcgcacgtatctttcttgggtccgcttcagtgggtctttgcctgtacatcatcaccttagtctataggctacgcaaaaaaaccgattggttagcgcggcgtttagattacgaagagctaatcaaagagatcggagtatgttttgaaggtgaggcggccactacgtcgtccgcgcaagctgcacttggtattattcagcgcttctttgatgccgatacgtgcgcgttagctctagtggaccatgaccgtaggtgggctgtcgaaacattcggtgcgaagcacccaaaacccgtgtgggacgacagggtgctacgcgaaatagtctctcgtaccaaagcgaacgaacgggcgacggtattccgcatcgtatcgacgcaaaaaatcgtacatttgcctcccgaaattccaggtctttcgatactactggctcacaaatccacagataaactaattgcggtttgttcactgggttaccaaagctatcgccctcgaccttgccaaggcgaaattcagcttcttgaactcgccaccgcctgcctctgtcactatatcgatgttcggcgtaagcagaccgaatgcgacgttttggccagacgattggagcatgcgcaacgccttgaggcagttggtacacttgccggcggaatagcacatgaatttaataacattttggggtcaatcctcgggcacgcagaattggcccaaaactcggtgtctcgaacatctgtcacccgaagatacattgactatatcatttcgtcaggcgacagagccatgctcattatcgatcagatcttgacgctgagccgaaaacaagagcgcgtgatcaagccatttagtgtctcagagcttgtgaccgaaatcgctcccttgctacgtatggctcttcccccaaccatcgagcttagtttcagatttgatcaaatgcagagcgtgatcgaaggaagcccgcttgaacttcaacaggtactaattaacctctgcaagaatgcttcccaagccatgactgcaaatggtcaaatcgacatcttcgtcggccaagcttatttaccagctaagaaaattctggcgcatggtgttatgccacctggcgactatgttctactatctgtcagcgacaatggtggaggcatttcagaggctgtgctaccctacatttttgaacccttctttacgacacgtgctcgcaacggtggaacgggtctcggcctcgcttctgtgcatggtcatatcagcgcgtttgcaggttacatcgacgttagttcaactgttgggcatgggacgcgctttgacatttatctccctccgtcttctaaggagcccgtcaatcccgacagctttttcggccgcaataaggcaccgcgtggaaacggggagattgtggcacttgttgagcccgatgacctcctgcgggaggcgtatgaagacaagatcgccgctctgggatatgagccggtcggttttcgtacctttagtgaaattcgcgattggatttcaaaaggcaatgaagccgatctggtcatggtcgaccaagcgtctcttcctgaagatcaaagtcctaattccgtggatttagtgctcaagaccgcctccatcatcattggcggaaatgatctcaaaatgcccctttcaagggagaatgcgaccagggacctttatctgccgaagccgatatcgtccagaactatggcgcatgcaatcctaaccaaaatcaagacgtag

SEQ ID NO: 27 - DNA, 744 bp, Agrobacterium tumefaciens
atggcgataaaattggtattgatactcgtattcacactctttcccgcggcagacgctgcatatgcgaatgaccgcgccaacggtttcatgtggtcaaacgggggcgaaactggagtgaggcttcctcttcgggtgttcaatgccaagccagccaagaacacggtggcgatcatttattccggagacgctggatggcaaaatatcgatgaggcgattggtacctatctgcagacggaagggattcctgtcattggcgtcagttcacttcggtatttctggtcggagcggtccccaagcgaaactgctaaggatcttggtcacataatcgatgtctacaccaagcatttcggtgtgcagaatgttttacttgtaggatattctttcggcgcggacgtcatgccggcaagcttcaataggcttacgcttgagcaaaaaaatcgggttaagcaaatctctctcttggcattgtcacatcaagtcgactatgtcgtctcatttaggggctggctccaactcgaaacggaaggtaagggcggcaatcctctggatgatctcagatccattgaccctgcaatcgtccaatgcatgtacgggcgcgaagaccgtaataatgcttgcccatctctccgacagaccggcgcagaggtgataggcttcagcggaggccatcactttgataatgatttcaaaaaactgtctacgcgcgtcgtctcaggcctcgtggcacgcctaagtcatcagtaa

SEQ ID NO: 28 - DNA, 7743 bp, Artificial sequence
  Synthetic construct
gtttacccgccaatatatcctgtcaaacactgatagtttaaactgaaggcgggaaacgacaatctgatcatgagcggagaattaagggagtcacgttatgacccccgccgatgacgcgggacaagccgttttacgtttggaactgacagaaccgcaacgttgaaggagccactcagcaagctggtacgattgtaatacgactcactatagggcgaattgagcgctgtttaaacgctcttcaactggaagagcggttacgctgtttaaacgctcttcaactggaagagcggttactaccggttcactagctagctgctaaggttaccagagctggtcacctttgtccaccaacttattaagtatctagttgaagacacgttcttcttcacgtaagaagacactcagtagtcttcggccagaatggcctcttgattcagcgggcctagaaggccggatcactgactagctaatttaaatcctgaggatatcgctatcaactttgtatagaaaagttgggccgaattcgagctcggtacggccagaatggcccggaccgggttacccggaccgaagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactctagaggatccaccggtcgccaccatggcccacagcaagcacggcctgaaggaggagatgaccatgaagtaccacatggagggctgcgtgaacggccacaagttcgtgatcaccggcgagggcatcggctaccccttcaagggcaagcagaccatcaacctgtgcgtgatcgagggcggccccctgcccttcagcgaggacatcctgagcgccggcttcaagtacggcgaccggatcttcaccgagtacccccaggacatcgtggactacttcaagaacagctgccccgccggctacacctggggccggagcttcctgttcgaggacggcgccgtgtgcatctgtaacgtggacatcaccgtgagcgtgaaggagaactgcatctaccacaagagcatcttcaacggcgtgaacttccccgccgacggccccgtgatgaagaagatgaccaccaactgggaggccagctgcgagaagatcatgcccgtgcctaagcagggcatcctgaagggcgacgtgagcatgtacctgctgctgaaggacggcggccggtaccggtgccagttcgacaccgtgtacaaggccaagagcgtgcccagcaagatgcccgagtggcacttcatccagcacaagctgctgcgggaggaccggagcgacgccaagaaccagaagtggcagctgaccgagcacgccatcgccttccccagcgccctggcctgaagcggccgcaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgccaccgcggtggagctcgaattccggtccgggtcacccggtccgggcctagaaggccgatctcccgggcacccagctttcttgtacaaagtggccgttaacggatcggccagaatggcccggaccgggttacccggaccgaagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactttaacttagcctaggatccatgcaaaaactcattaactcagtgcaaaactatgcctggggcagcaaaacggcgttgactgaactttatggtatggaaaatccgtccagccagccgatggccgagctgtggatgggcgcacatccgaaaagcagttcacgagtgcagaatgccgccggagatatcgtttcactgcgtgatgtgattgagagtgataaatcgactctgctcggagaggccgttgccaaacgctttggcgaactgcctttcctgttcaaagtattatgcgcagcacagccactctccattcaggttcatccaaacaaacacaattctgaaatcggttttgccaaagaaaatgccgcaggtatcccgatggatgccgccgagcgtaactataaagatcctaaccacaagccggagctggtttttgcgctgacgcctttccttgcgatgaacgcgtttcgtgaattttccgagattgtctccctactccagccggtcgcaggtgcacatccggcgattgctcactttttacaacagcctgatgccgaacgtttaagcgaactgttcgccagcctgttgaatatgcagggtgaagaaaaatcccgcgcgctggcgattttaaaatcggccctcgatagccagcagggtgaaccgtggcaaacgattcgtttaatttctgaattttacccggaagacagcggtctgttctccccgctattgctgaatgtggtgaaattgaaccctggcgaagcgatgttcctgttcgctgaaacaccgcacgcttacctgcaaggcgtggcgctggaagtgatggcaaactccgataacgtgctgcgtgcgggtctgacgcctaaatacattgatattccggaactggttgccaatgtgaaattcgaagccaaaccggctaaccagttgttgacccagccggtgaaacaaggtgcagaactggacttcccgattccagtggatgattttgccttctcgctgcatgaccttagtgataaagaaaccaccattagccagcagagtgccgccattttgttctgcgtcgaaggcgatgcaacgttgtggaaaggttctcagcagttacagcttaaaccgggtgaatcagcgtttattgccgccaacgaatcaccggtgactgtcaaaggccacggccgtttagcgcgcgtttacaacaagctgtaaatcactagcgaacgcgtaggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgccaccgcggtggagctcgaattccggtccgggtcacccggtccgggcctagaaggccagcttcggccgccccgggcaactttattatacaaagttgatagatatctggtctaactaactagtcctaaggacccggcggaccgattaaactgattcggtccgaagcttaagccatggcccgggaatcttagcggccgcctgcagagttaacggcgcgccgactagctagctaaggtaccgagctcgaattcattccgattaatcgtggcctcttgctcttcaggatgaagagctatgtttaaacgtgcaagcgctactagacaattcagtacattaaaaacgtccgcaatgtgttattaagttgtctaagcgtcaatttgtttacaccacaatatatcct

SEQ ID NO: 29 - DNA, 6496 bp, Artificial sequence
  Synthetic construct
gtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactttaacttagcctagcgaagttcctattccgaagttcctattctctagaaagtataggaacttcagatccaccggctagaggatccaccatggttgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgatgatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaggatccaccatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaattgcggccgggtaccgagctcgaattcggcccaagtttgtacaaaaaagcaggctccggccagaatggcccggaccgaagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactctagaggatccaccggtcgccaccatggccctgtccaacaagttcatcggcgacgacatgaagatgacctaccacatggacggctgcgtgaacggccactacttcaccgtgaagggcgagggcagcggcaagccctacgagggcacccagacctccaccttcaaggtgaccatggccaacggcggccccctggccttctccttcgacatcctgtccaccgtgttcatgtacggcaaccgctgcttcaccgcctaccccaccagcatgcccgactacttcaagcaggccttccccgacggcatgtcctacgagagaaccttcacctacgaggacggcggcgtggccaccgccagctgggagatcagcctgaagggcaactgcttcgagcacaagtccaccttccacggcgtgaacttccccgccgacggccccgtgatggccaagaagaccaccggctgggacccctccttcgagaagatgaccgtgtgcgacggcatcttgaagggcgacgtgaccgccttcctgatgctgcagggcggcggcaactacagatgccagttccacacctcctacaagaccaagaagcccgtgaccatgccccccaaccacgtggtggagcaccgcatcgccagaaccgacctggacaagggcggcaacagcgtgcagctgaccgagcacgccgtggcccacatcacctccgtggtgcccttctgaagcggccgcaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgccaccgcggtggagctcgaattccggtccgggcctagaaggccgatctcccgggcacccagctttcttgtacaaagtggccgttaacggatcccggtgaagttcctattccgaagttcctattctccagaaagtataggaacttc

SEQ ID NO: 30 - DNA, 1991 bp, Artificial sequence
  Synthetic construct
gtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcag

SEQ ID NO: 31 - DNA, 685 bp, Discosoma sp.
cgccaccatggcctcctccgagaacgtcatcaccgagttcatgcgcttcaaggtgcgcatggagggcaccgtgaacggccacgagttcgagatcgagggcgagggcgagggccgcccctacgagggccacaacaccgtgaagctgaaggtgacgaagggcggccccctgcccttcgcctgggacatcctgtccccccagttccagtacggctccaaggtgtacgtgaagcaccccgccgacatccccgactacaagaagctgtccttccccgagggcttcaagtgggagcgcgtgatgaacttcgaggacggcggcgtggcgaccgtgacccaggactcctccctgcaggacggctgcttcatctacaaggtgaagttcatcggcgtgaacttcccctccgacggccccgtgatgcagaagaagaccatgggctgggaggcctccaccgagcgcctgtacccccgcgacggcgtgctgaagggcgagacccacaaggccctgaagctgaaggacggcggccactacctggtggagttcaagtccatctacatggccaagaagcccgtgcagctgcccggctactactacgtggacgccaagctggacatcacctcccacaacgaggactacaccatcgtggagcagtacgagcgcaccgagggccgccaccacctgttcctgtag

SEQ ID NO: 32 - DNA, 48 bp, Saccharomyces cerevisiae
gaagttcctattccgaagttcctattctctagaaagtataggaacttc

SEQ ID NO: 33 - DNA, 48 bp, Saccharomyces cerevisiae
gaagttcctattccgaagttcctattctccagaaagtataggaacttc

SEQ ID NO: 34 - DNA, 18676 bp, Artificial sequence
  Synthetic construct
gcatggcatgccgaatccatgtgggagtttattcttgacacagatatttatgatataataactgagtaagcttaacataaggaggaaaaacatatgttacgcagcagcaacgatgttacgcagcagggcagtcgccctaaaacaaagttaggtggctcaagtatgggcatcattcgcacatgtaggctcggccctgaccaagtcaaatccatgcgggctgctcttgatcttttcggtcgtgagttcggagacgtagccacctactcccaacatcagccggactccgattacctcgggaacttgctccgtagtaagacattcatcgcgcttgctgccttcgaccaagaagcggttgttggcgctctcgcggcttacgttctgcccaagtttgagcagccgcgtagtgagatctatatctatgatctcgcagtctccggcgagcaccggaggcagggcattgccaccgcgctcatcaatctcctcaagcatgaggccaacgcgcttggtgcttatgtgatctacgtgcaagcagattacggtgacgatcccgcagtggctctctatacaaagttgggcatacgggaagaagtgatgcactttgatatcgacccaagtaccgccacctaataatgtctaacaattcgttcaagccgacgccgcttcgcggcgcggcttaactcaagcgttagatgcactatacgtaccaatccaaatcggatccccctgcagggctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagcagatctatcgatggtacctatctgcagacggaagggattcctgttaattaaaacagcttgcgtcatgcggtcgctgcgtatatgatgcgatgagtaaataaacaaatacgcaaggggaacgcatgaaggttatcgctgtacttaaccagaaaggcgggtcaggcaagacgaccatcgcaacccatctagcccgcgccctgcaactcgccggggccgatgttctgttagtcgattccgatccccagggcagtgcccgcgattgggcggccgtgcgggaagatcaaccgctaaccgttgtcggcatcgaccgcccgacgattgaccgcgacgtgaaggccatcggccggcgcgacttcgtagtgatcgacggagcgccccaggcggcggacttggctgtgtccgcgatcaaggcagccgacttcgtgctgattccggtgcagccaagcccttacgacatatgggccaccgccgacctggtggagctggttaagcagcgcattgaggtcacggatggaaggctacaagcggcctttgtcgtgtcgcgggcgatcaaaggcacgcgcatcggcggtgaggttgccgaggcgctggccgggtacgagctgcccattcttgagtcccgtatcacgcagcgcgtgagctacccaggcactgccgccgccggcacaaccgttcttgaatcagaacccgagggcgacgctgcccgcgaggtccaggcgctggccgctgaaattaaatcaaaactcatttgagttaatgaggtaaagagaaaatgagcaaaagcacaaacacgctaagtgccggccgtccgagcgcacgcagcagcaaggctgcaacgttggccagcctcgcagacacgccagccatgaagcgggtcaactttcagttgccggcggaggatcacaccaagctgaagatgtacgcggtacgccaaggcaagaccattaccgagctgctatctgaatacatcgcgcagctaccagagtaaatgagcaaatgaataaatgagtagatgaattttagcggctaaaggaggcggcatggaaaatcaagaacaaccaggcaccgacgccgtggaatgccccatgtgtggaggaacgggcggttggccaggcgtaagcggctgggttgcctgccggccctgcaatggcactggaacccccaagcccgaggaatcggcgtgagcggtcgcaaaccatccggcccggtacaaatcggcgcggcgctgggtgatgacctggtggagaagttgaaggcagcgcaggccgcccagcggcaacgcatcgaggcagaagcacgccccggtgaatcgtggcaagcagccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggcaggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctagctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagccgaagagctgcaaaaagcgcctacccttcggtcgctgcgctccctacgccccgccgcttcgcgtcggcctatgcatataattgtggtttcaaaatcggctccgtcgatactatgttatacgccaactctgaaaacaactttgaaaaagctgttttctggtatttgacccgcgaggtttctcgcttcaattgaaatcataaagaagcaattgaaaattttcgagtaaccgaccctcccgataatcttcaacataaaacaacgcacttcttccaacgggagaggcggtgttagttgcgagctaaggagataaggtatgcttaagagatcggggtcgctttctcttgccttgatggtctccttctgttcgtcgagccttgccacgccactctcatctgctgagtttgaccatgttgctcgcaagtgtgccccatcagttgcgacatctacgcttgcggcgatagctaaggtggagagtcgctttgatcctttagcgattcatgacaacacgaccggcgaaacgcttcactggcaagatcacagccaagcaacccaagtcgtcaggcaccgtctcgatgcacggcattcgctggatgttggcctcatgcaaataaactctcgaaatttttctatgctcggtctgacacctgacggtgcgctccaggcgtgcacatcattatctgccgctgcaaacatgctgaaaagtcgttatgcaggcggcgaaacgattgacgagaagcaatttgcgcttcgtcgggcgatctccgcttacaacaccggtaatttcatcggcggttttgcaaacggctacgtgcgaaaagttgaaacagctgctcaatcgctggtgcccgcgttaatcgagcctccaaaagacgatcacgaggcgctaaaatccgaagagacgtgggatgtttgggggtcatatcagcgccgctcgcaggaggatggcgctggcggtttaatcgctccgccaccgccacaccaggacaacggcaaatccgcagacgacaatcaagtcttattcgacttatactaaggaggtgcgcattgatgcgatgctttgagagataccgtttacatctaaatcgcctctcgctctcgaatgcgatgatgcgcgtgatatcgagctgcgccccaagcttgtgcggtgcaattgcatggagcatttcctcatccggacccgccgcagcgcaatctgcgggtggcggcactgaccccgccacaatggttaacaatatatgcacgtttatccttggtccgttcggccagtcactcgctgttctcggcattgtcgctatcgggatctcctggatgttcgggcgggcttcgcttgggctggttgccggcgtcgtcggcggcattgttatcatgtttggggcgagcttcctcggccaaacgctcactggcggtagttgatggctgatcgtttggaagaatcgaccctttacctcgcagccacacggcccgcattgtttcttggggtgccactgacattggcagggttattcatgatgttcgccggctttgtcatcgttatcgttcagaacccgctctacgaagtcgttctcgtgccgttatggtttgcagcccggctcatcgtggagcgagactacaatgcggcgagcgtcgtcctgctatttttgcggaccgcgggaagaagcattgatagtgcagtttgggggggcgctactgttagcccaaatccaattagggttcccccacgagggagaggaatggtgtgatgctcggcgcgagtggaacgaccgaaagatccggtgagatctatctcccttatattggccacctcagcgaccatatcgtccttcttgaagacggatcgatcatgaccattgcgagaattgatggcgttgcattcgagcttgaggaaactgaaatgcgcaatgcgcgttgtcgtgcgttcaacacgctgttgcgcaatatcgctgatgatcatgtgtcaatatatgctcacctcgtacgtcatgccgacgtgccatcatcggcgccgcgacacttccgtagtgttttcgccgctagcctgaacgaagcttttgaacagcgcgtgctctccggccaactcctccgcaatgaacacttccttacgttgattgtctacccacaggcggctttagggaaggtaaagaggaggttcaccaagctaagcggaaaaagggaaaacgatctcacgggccagatcaggaacatggaagatctttggcatgttgtcgctggctctcttaaagcgtatggcctgcatcgtcttggcatccgcgagaagcagggtgtgctcttcaccgaaattggcgaagcgctacggttgatcatgactggtcggttcacaccggttccggtcgtcagcggctcactcggcgcttcgatttataccgacagagtcatttgcggcaagcgaggactcgagatcagaacgccaaaagacagttacgttggatccatctattcgtttcgcgaataccctgcaaaaacacggccgggcatgctcaacgcgctgctatccctcgattttccacttgttctcacgcagagtttttcgttcctgactcgcccgcaagcgcacgcgaaacttagcctcaaatcgagccagatgctgagttccggcgataaagccgtgactcaaatcggcaaattatccgaggctgaggacgcacttgcgagcaacgaattcgttatgggctcacatcatttgagcctttgcgtctatgcagacgatctcaatagtcttggggacaggggcgcgcgggctcggacacgaatggcggatgcaggtgccgtggttgtccaagaaggtattggtatggaagcggcctattggtcccaattgccggggaattttaagtggcgcacacgccctggcgcaatcacttcacgcaatttcgcagggtttgtctctttcgaaaactttccagagggcgccagctcaggccactggggcaacgcgattgcccgatttcgtaccaatggcggaacgcctttcgactatatcccgcatgagcacgatgttggcatgacggcaatattcgggcctatcgggaggggtaagacgacgctcatgatgtttgttctagccatgctcgaacagagcatggtcgaccgtgcaggtacggtcgtgttctttgacaaggaccggggtggcgaattgctggttcgcgccacaggaggaacatatttggcacttcacagaggcacacccagcgggttggcgccgttgcgtggcctagaaaacacagcagcctcacacgattttctgcgcgaatggatcgtggctctcatcgagagtgatggtcggggtgggatttctccggaagagaaccgccgtctggtccgtggtatccatcgtcagctctcgtttgatccacaaatgcgttcaatcgcggggttacgtgaatttttgttgcatgggcccgccgaaggcgcaggagcgcggctccaacgctggtgccggggccatgcgcttggctgggcatttgacggcgaagttgacgaagtaaagttagatccgtcgattaccggcttcgacatgacgcatcttctcgaatacgaggaagtatgcgctcccgctgcagcatatctcctgcatcggattggagccatgatcgacggccgccgttttgtgatgagctgcgatgagtttcgcgcctatttgttaaaccctaaattttcgactgtcgtcgacaaattcctcctgaccgttcgaaaaaacaacgggatgctaatactggcaacgcagcaaccagagcatgttctggaatcgccgctaggagccagcttggttgcgcaatgtatgacgaagattttctatccatcaccaaccgcagatcgatcggcttatgtcgatggactgaaatgtaccgaaaaggaatttcaggcgatccgtgaagacatgacggtcggcagccgtaagtttcttcttaaacgagaaagtggaagcgtcatctgcgaatttgatctgcgggatatgcgtgaatatgtcgccgtgctttcggggcgtgccaacacggtgcgctttgcaactcgactacgcgaggcacaagaaggcaactcatctggctggctcagcgaattcatggcccgtcaccacgaggcagaagattgataaggtaggaaacgatgaagacgacgcaacttattgcaacagttttgacctgcagctttctatatattcagcccgcgcgggcgcagtttgttgttagcgacccggcaacggaggctgagacgctcgcgactgcgctcgcgactgcggagaatctcactcagactatagcgatggttacgatgttgacgtcggcctacggcgttactggactactgacttcgctcaaccagaaaaatcagtatccttcgacgaaggacctagacaatgaaatgttttcgccgcgaatgccaatgtcgaccacggcacgtgcgatcaccagcgatacagatcgtgcagtcgtgggtagtgatgctgaagcggacctgttgcgatcgcagatcaccggttccgcaaacagcgctggcattgcggctgacaatctggaaacgatggacaaacgcttgacggcgaatgctgatacgtctgctcagctttcccgatctcgcaatatcatgcaggcaaccgtgaccaatggtttgcttctcaagcagatccatgacgcaatgattcaaaatgtacaggcgacaagcctattaacgatgactaccgcgcaggccggccttcacgaggcggaagaggcggccgctcaacgcaaggagcatcaaaagaccgctgtcatctttggtgccctcccctaaggctgggcgatttgttcatccgcccgcatcctcgccgaatgcgagctcattttatccaacattatgcgacaaaccagtcaagttcaggtccaatcgatgaatttcacgattccggcgccgtttacggccattcatacgatcttcgatgtagccttcacgacaggcttggactcgatgcttgagactatccaggaggcggtgagtgcgccattgatcgcctgtgtcactctttggattattgttcagggtattttagtcatacgcggcgaagtcgatacccgtagcggtatcactcgggtgatcacggtcaccatcgttgttgctctaattgttgggcaggctaactaccaagactatgtggtttccatcttcgaaaagacggtcccaaactttgttcagcagtttagtgtaaccggcttgcctctgcagactgttccggcacagttggatacaatgttcgccgtgacccaggccgtttttcagaaaatcgcatccgaaatcggtccgatgaacgaccaggacatccttgctttccaaggggcacagtgggtcctttacggcacgctctggtctgccttcggagtttacgacgccgttggaattctcacgaaagtgcttctcgcgatcgggcctctgatcctcgtcggatatatttttgatcgcacgcgggacatcgcagctaagtggatcgggcaacttatcacctacggtctcttgcttctcctcttaaacctcgtggcaacgatcgtcatcctaaccgaagcgactgcgctcacccttatgcttggtgtaatcaccttcgccggtacgaccgcggccaagatcattggtctttacgaactcgatatgttttttctgacaggggatgcgctcattgtcgctttgccggcgatcgccggcaacattggaggcagttactggagcggcgcaacccaatctgccagcagcttgtaccgtcgcttcgctcaggttgagcgaggctaggtcgcgcaaaaattcgcctcaatggagaattctatgaagtattgcctgctgtgcctagttgtcgctttgagcggctgccagacaaacgacacattagcgagctgcaaaggcccgatcttcccgctgaatgtggggcgatggcagcctactccgtcagatcttcagctcggcaattcgggtggacgctatgacggggcctgaatatgccatgctagtggcgcgcgaaagccttgccgagcactataaggaagtagaagcctttcaaaccgcgcgagcgaaatcggcgcgacgtctctccaaactcattgcagctgtcgcagctatcgcgattttgggaaatgttgctcaagcgttcgctatagccacaatggtgccgttgagcaggcttgtgcccgtatatctatggatacggccggacggcaccgttgacagcgaggtgtctgtctcgcgattgcctgcaactcaagaggaggccgtcgttaacgcctcattgtgggagtacgttcgcctgcgcgagagttatgatgccgacaccgctcagtacgcctacgacctggtatcgaacttcagtgccccaacagtgcgccaggattaccagcaattcttcaactatcccaatcccagttcgcctcaagtcattcttggcaaacgcggcagggtggaggtcgagcacatcgcttcaaatgatgtaactccaagcacgcagcaaattcgctataaaaggaccctcgtcgttgacggcaaaatgcctgtggtgagtacgtggaccgcgacagttcgctacgaaaaggtgaccagcttgcccggcagattgagactaaccaacccggcaggtctggttgtcacctcctatcagacatcggaagataccgtttcaaacgtaggccacagcgaaccatgatcagaaaagcacttttcattttagcatgtttatttgccgctgcgactggtgcggaggctgaagacactccaatggcgggcaagctagatccgcgcatgcgttatttggcttacaatcccgatcaagtggtgcgcctctcgacggcggttggagctactttggtcgtaacattcgccacgaacgaaacggtgacagcggttgccgtttcaaatagcaaagatctagcagccctaccgcggggaaattatctatttttcaaggcaagccaggtcctcacgcctcagccagtaatcgtgctaaccgcaagcgactccgggatgcgccgttatgttttcagtataagttccaagactctgtcccacctcgataaagagcagcccgatctctattacagcgtccaattcgcctaccccgccgacgatgcggcggctcggcgaagggaggcacaacagaaggctgttgtggacagactacacgcggaagcacaatatcaacggaaagctgagaatttattggatcagcctgtcacagcccttggtgcggcggacagtaattggcactacgtcgcccaaggcgatcgttcgctgttgccactcgaagtcttcgacaatggatttacgacggtattccactttccgggcaatgtacgcataccctccatctacaccatcaatcctgatggcaaggaagctgttgccaactattcagttaaagggagcgatgtcgagatttcttcggtttcccgaggttggcgtctgagggatggccacacagtactatgtatctggaacaccgcttacgatcccgttggccaaaggccgcaaacgggcacggtgaggcccgatgtgaaacgcgtcctgaagggggcgaagggatgaataacgatagtcagcaagcggcacatgaggttgatgcatctggatccctggtctccgacaaacatcgccggcgtctttcggggtctcagaaattgatcgtcggaggtgtcgttctcgcgttatcattaagcctcatttggctaggtgggcgccaaaagaaggtgaatgagaacgcatcgccgtcaactttgatcgcaacaaacaccaagccatttcatccagctccgattgaggtgccgccggatcctccagcggttcaagaggctgttcagcctgctgctcctctaccgccgaggggcgaaccggagcggcatgagccacggccggaagaaacaccgatttttgcatatagcagcggcgatcaaggggtcagcaaacgcgccattcagggcgacacgggccgaagacaagaaggcaagcgtgacgacaactccttgccgaatggcgaagtgtccggcgagaacgatttgtcgatacgtatgaaacccaccgagctgcagcccagcagcgccacgctcttgccgcaccccgattttatggtaacgcaagggacaataattccgtgcatcttgcaaaccgcaatcgacacaaatttggcaggctatgtaaagtgtgtcttgcctcaggatattcgtggaacaacgaacaatatcgtgcttcttgatcgtggcaccaccgttgttggcgaaatacagcgtggcttgcaacagggagatgggcgcgtttttgtgttgtgggatcgcgccgagacacctgaccatgcgatgatctcgttaacatcgccaagcgcggacgaactcggtcgctcaggattgccgggctcggtcgacagccacttctggcagcgttttagcggagctatgctcttgagtgttgttcaaggcgccttccaggcagctagcacctacgccggcagctcgggtggcgggatgagcttcaacagctttcaaaataacggtgagcagacaactgagacagcccttaaggcaaccatcaacataccgccaaccctgaagaagaatcagggtgacaccgtttccattttcgtagcacgggacctcgatttctttggtgtttaccagctccgcctgactggcggcgccacgcgggggaggaaccgccgctcttaatgaattcaaatttccgcttagagataggatacattgtaaatggaagtggatccgcaactacgctttcttctgaagccgattttggaatggctcgatgacccgaagactgaagaaattgcgatcaatcgacctggagaggcatttgtgcgccaagccggcatttttaccaagatgcctttgcccgtctcttatgatgatcttgaagatatcgctattttagcgggcgcgctgagaaagcaggatgtcggaccacgtaaccccctctgcgccactgaacttcctggtggtgaacgactacaaatctgtctgccgccgaccgttccctcgggcaccgtcagcttgaccattcgacggccaagctcgcgtgtttctggtcttaaagaagtctcctcccgttatgatgcttcgaggtggaaccagtggcagacacgaaggaaacgccaaaatcaggatgatgaagctatccttcagcattttgacaacggggatttggaagcgtttctgcacgcatgcgtcgtcagccgactgacgatgttgctatgtggccctaccggaagcggcaagacaacaatgagcaagaccttgatcagcgccatccccccccaggaaaggctaatcaccatagaagatacgctcgaactcgtcattccacacgataatcatgttagactactctactccaagaacggtgctgggctgggtgctgtgagcgccgagcacttgctccaagcaagtctgcgtatgcggccggaccggatattgcttggcgagatgcgcgacgatgcagcatgggcttatctgagtgaagtcgtctcgggacatccgggatcgatttcaacaatacacggcgcgaatccaatccaaggattcaagaaactgttttcccttgtcaaaagtagcgcccaaggtgctagcttggaagatcgcacactgattgacatgctctctacggcgatcgatgtcatcattccattccgtgcctatgaggacgtttatgaagtaggcgagatctggctcgcggcggacgcacgacgccggggcgagaccataggcgatctccttaatcaatagtagctgtaacctcgaagcgtttcacttgtaacaacgattgagaacttttgtcataaaattgaaatacttggttcgcattttcgtcatccgcggtcagccgcaattctgacgaactgcccatttagctggagatgattgtacatccttcacgtgaaaatttctcaagcgctgtgaacaagggttcagattttagattgagaggtgagccgttgaaacacgttcttcttatcgatgacgatgtcgctatgcggcatcttattatcgaataccttacgatccacgccttcaaagtgaccgcggtagccgacagcacccagttcactagagtactctcttccgcgacggtcgatgtcgtggttgttgatctaaatttaggtcgtgaagatgggcttgagatcgttcgaaatctggcggcaaagtctgatattccaatcataattatcagtggcgaccgccttgaggagacggataaagttgttgcactcgagctaggagcaagtgattttatcgctaagccgtttagtacgagagagtttcttgcacgcattcgggttgccttgcgcgtgcgccccaacgttgtccgctccaaagaccgacggtctttttgttttactgactggacacttaatctcaggcaacgtcgcttgatgtccgaagctggcggtgaggtgaaacttacggcaggtgagttcaatcttctcctcgcgtttttagagaaaccccgcgacgttctatcgcgcgagcaacttctcattgccagtcgagtacgcgacgaggaggtttacgacaggagtatagatgttctcattttgcggctgcgccgcaaacttgaggcggatccgtcaagccctcaactgataaaaacagcaagaggtgccggttatttctttgacgcggacgtgcaggtttcgcacggggggacgatggcagcctgagccaattgcatttgattaatttaggtgactgaggacgcggccagcggcctcaaacctacactcaatatttggtgaggggttccgataggtccctcttcaccaattgctcgatggcttctctccagcaaagaatgacgcgagcgcggcggtagccagcttgtggccgaaagctcgagcggtctccaaccccaacggatcaaaatgacttcgagcgacctcgagcaacgcaaccgggaacatgcgtgaggtctgaacgagaacggatttttctgtagttgaagggatcggataacttttcggggccacgcgaaatgatccatctgccagcatgctttcgaaatcgtccaacgcgcgccttaaaatcatttgtagcgacttcgagggactgtattgccgaacgaggttgtcatatgttttcgacacttgaggcgcgggcggtcgcgctgaaagaaaaacctggagctttttcggggacggaggtggactaagggcatccacagttagcttaagttgtcgatcgggactgtaaatgtgatcggcgacgagaggctcacgttgctggtctttctcgtcggctttttcaggcaagtgctggaggtccagcttctggggaacaagtgtcgggttgggatggtggatctcgggtcgagcaccagcaagccgccgtgcttcgccgaccgacaatgcgggcttgcgaattgccatcttcaagcctccaagattttgctgatcagtttcgaaatgaccacgacttcctccatcgcaatccgaagattcctctctatgaggcgcatcgtcggatcagttcccgtgtttagtaatgtaagatgcaacatgccgcgttctttcatcgcggcaaatgcatctctttcatgcatgggagacggtacaactggaaggctctctagcgtctctgacatcctgcgttgcgatgttgtcaatcggccgaccgggacgcgttggcgcaaaacagctgtaggaattgccaaattttcactcaacagcagctcgatgacgtagcggtaggtagatagtgcctcatcgatgtcgagcggcgttagcatggtggggatcagaagcaggtttgagctagcgatgattgtgttgttgagctcgctcgagccgccacgcgtatcggccaacgcataatcaaatccttcgagctcggcattttcataggctgcttcaagaaggggcatttcgtcggcggaatagacttcacagcgaggatcccaggtactgctttgtaaggcgttttctctccatcgcgtcagaggccggttttcgtcggcatcaaagagggccactcgtttaccgtcatttgccaaagcagcgcaaaggcccatgagtgcggtggttttgccagcaccccctttgaaagaacaaaacgtcaaaagttgcatattctgatcccgcctatcctgtgaaaccggagtgcatttgtatttttgttcgtataaatgtttttgtgattatcgatgagtaaaagcgttgttacactatttttatttcacattcgttataagacaattgcaaatgtagcaagtatattcagtattgactgtaaatgtactgttgatttcatattgagcagggctagacttccatccgtctacccgggcacatttcgtgctggagtatccagaccttccgctttctttggaggaagctatgtcaaaacacaccagagccacgtcgagtgagactaccatcaaccagcatcgatccctgaaagttgaagggttcaaggtcgtgagtgcccgtctgcgatcggccgagtatgaaaccttttcctatcaagcgcgcctgctgggactttcggatagtatggcaattcgcgttgcggtgcgccgcatcgggggctttctcgaaatagatgcagacacacgagaaaagatggaagccatacttcagtccatcggaatactctcaagcaatgtatccatgcttctatctgcctacgccgaagaccctcgatcggatctggaggctgtgcgagatgaacgtattgcttttggcgaggctttcgccgccctcgatggactactgcgctccattttgtccgtatcccggcgacggatcgacggtcgctcgttactgaaaggtgccttgtagcacttgaccacgcacctgacgggagaaaattggatgcccgatcgcgctcaagtaatcattcgcattgtgccaggaggtggaaccaagacccttcagcagataatcaatcagctggagtacctgtcccgaaagggaaagctggaactgcagcgttcagcccggcatctcgatattcccgttccgccggatcaaatccgtgagcttgcccaaagctgggttacggaggccgggatttatgacgaaagtcagtcagacgatgacaggcaacaagacttaacaacacacattattgtaagcttccccgcaggtaccgaccaaaccgcagcttatgaagcaagccgggaatgggcagccgagatgtttgggtcaggatacgggggtggccgctataactatctgacagcctaccacgtcgaccgcgatcatccacatttacatgtcgtggtcaatcgtcgggaacttctggggcaggggtggctgaaaatatccaggcgccatccccagctgaattatgacggcttacggaaaaagatggcagagatttcacttcgtcacggcatagtcctggatgcgacttcgcgagcagaaaggggaatagcagagcgaccaatcacatatgctgaatatcgacgccttgagcggatgcaggctcaaaagattcaattcgaagatacagattttgatgagacctcgcctgaggaagatcgtcgggacctcagtcaatcgttcgatccatttcgatcggacgcatctgccggcgaaccggaccgtgcaacccgacatgacaaacaaccgcttgaaccgcacgcccgtttccaggagcccgccggctccagcatcaaagccgacgcacggatccgcgtaccattggagagcgagcggggtgcccaaccatccgcgtccaaaatccctgtaactgggcatttcgggattgagacttcgtatgtcgctgaagccagcgtgcccaaacaaagcggcaattccgatacttctcgcccggtgactgacgttgccatgcacacagtcgagcgccagcagcgatcaaaacgacgtcatgacgaggaggcaggtccgagcggagcaaaccgtaaaagattgaaggccgcgcaagttgattccgaggcaaatgtcggtgagcccgacggtcgcgatgacagcaacaaggcggctgatccggtgtctgcttccatccgtaccgagcaaccggaagcttctccaacgtgtccgcgtgaccgtcacgatggagaattgggagaacgcaaacgtgcaagaggtaatcgtcgcgacgatgggcgcggggggacctagactagtgtacctcgcgaatgcatctagatccaatccaatat

SEQ ID NO: 35 - DNA, 28390 bp, Artificial sequence
  Synthetic construct
gacccgcgaggtttctcgcttcaattgaaatcataaagaagcaattgaaaattttcgagtaaccgaccctcccgataatcttcaacataaaacaacgcacttcttccaacgggagaggcggtgttagttgcgagctaaggagataaggtatgcttaagagatcggggtcgctttctcttgccttgatggtctccttctgttcgtcgagccttgccacgccactctcatctgctgagtttgaccatgttgctcgcaagtgtgccccatcagttgcgacatctacgcttgcggcgatagctaaggtggagagtcgctttgatcctttagcgattcatgacaacacgaccggcgaaacgcttcactggcaagatcacagccaagcaacccaagtcgtcaggcaccgtctcgatgcacggcattcgctggatgttggcctcatgcaaataaactctcgaaatttttctatgctcggtctgacacctgacggtgcgctccaggcgtgcacatcattatctgccgctgcaaacatgctgaaaagtcgttatgcaggcggcgaaacgattgacgagaagcaatttgcgcttcgtcgggcgatctccgcttacaacaccggtaatttcatcggcggttttgcaaacggctacgtgcgaaaagttgaaacagctgctcaatcgctggtgcccgcgttaatcgagcctccaaaagacgatcacgaggcgctaaaatccgaagagacgtgggatgtttgggggtcatatcagcgccgctcgcaggaggatggcgctggcggtttaatcgctccgccaccgccacaccaggacaacggcaaatccgcagacgacaatcaagtcttattcgacttatactaaggaggtgcgcattgatgcgatgctttgagagataccgtttacatctaaatcgcctctcgctctcgaatgcgatgatgcgcgtgatatcgagctgcgccccaagcttgtgcggtgcaattgcatggagcatttcctcatccggacccgccgcagcgcaatctgcgggtggcggcactgaccccgccacaatggttaacaatatatgcacgtttatccttggtccgttcggccagtcactcgctgttctcggcattgtcgctatcgggatctcctggatgttcgggcgggcttcgcttgggctggttgccggcgtcgtcggcggcattgttatcatgtttggggcgagcttcctcggccaaacgctcactggcggtagttgatggctgatcgtttggaagaatcgaccctttacctcgcagccacacggcccgcattgtttcttggggtgccactgacattggcagggttattcatgatgttcgccggctttgtcatcgttatcgttcagaacccgctctacgaagtcgttctcgtgccgttatggtttgcagcccggctcatcgtggagcgagactacaatgcggcgagcgtcgtcctgctatttttgcggaccgcgggaagaagcattgatagtgcagtttgggggggcgctactgttagcccaaatccaattagggttcccccacgagggagaggaatggtgtgatgctcggcgcgagtggaacgaccgaaagatccggtgagatctatctcccttatattggccacctcagcgaccatatcgtccttcttgaagacggatcgatcatgaccattgcgagaattgatggcgttgcattcgagcttgaggaaactgaaatgcgcaatgcgcgttgtcgtgcgttcaacacgctgttgcgcaatatcgctgatgatcatgtgtcaatatatgctcacctcgtacgtcatgccgacgtgccatcatcggcgccgcgacacttccgtagtgttttcgccgctagcctgaacgaagcttttgaacagcgcgtgctctccggccaactcctccgcaatgaacacttccttacgttgattgtctacccacaggcggctttagggaaggtaaagaggaggttcaccaagctaagcggaaaaagggaaaacgatctcacgggccagatcaggaacatggaagatctttggcatgttgtcgctggctctcttaaagcgtatggcctgcatcgtcttggcatccgcgagaagcagggtgtgctcttcaccgaaattggcgaagcgctacggttgatcatgactggtcggttcacaccggttccggtcgtcagcggctcactcggcgcttcgatttataccgacagagtcatttgcggcaagcgaggactcgagatcagaacgccaaaagacagttacgttggatccatctattcgtttcgcgaataccctgcaaaaacacggccgggcatgctcaacgcgctgctatccctcgattttccacttgttctcacgcagagtttttcgttcctgactcgcccgcaagcgcacgcgaaacttagcctcaaatcgagccagatgctgagttccggcgataaagccgtgactcaaatcggcaaattatccgaggctgaggacgcacttgcgagcaacgaattcgttatgggctcacatcatttgagcctttgcgtctatgcagacgatctcaatagtcttggggacaggggcgcgcgggctcggacacgaatggcggatgcaggtgccgtggttgtccaagaaggtattggtatggaagcggcctattggtcccaattgccggggaattttaagtggcgcacacgccctggcgcaatcacttcacgcaatttcgcagggtttgtctctttcgaaaactttccagagggcgccagctcaggccactggggcaacgcgattgcccgatttcgtaccaatggcggaacgcctttcgactatatcccgcatgagcacgatgttggcatgacggcaatattcgggcctatcgggaggggtaagacgacgctcatgatgtttgttctagccatgctcgaacagagcatggtcgaccgtgcaggtacggtcgtgttctttgacaaggaccggggtggcgaattgctggttcgcgccacaggaggaacatatttggcacttcacagaggcacacccagcgggttggcgccgttgcgtggcctagaaaacacagcagcctcacacgattttctgcgcgaatggatcgtggctctcatcgagagtgatggtcggggtgggatttctccggaagagaaccgccgtctggtccgtggtatccatcgtcagctctcgtttgatccacaaatgcgttcaatcgcggggttacgtgaatttttgttgcatgggcccgccgaaggcgcaggagcgcggctccaacgctggtgccggggccatgcgcttggctgggcatttgacggcgaagttgacgaagtaaagttagatccgtcgattaccggcttcgacatgacgcatcttctcgaatacgaggaagtatgcgctcccgctgcagcatatctcctgcatcggattggagccatgatcgacggccgccgttttgtgatgagctgcgatgagtttcgcgcctatttgttaaaccctaaattttcgactgtcgtcgacaaattcctcctgaccgttcgaaaaaacaacgggatgctaatactggcaacgcagcaaccagagcatgttctggaatcgccgctaggagccagcttggttgcgcaatgtatgacgaagattttctatccatcaccaaccgcagatcgatcggcttatgtcgatggactgaaatgtaccgaaaaggaatttcaggcgatccgtgaagacatgacggtcggcagccgtaagtttcttcttaaacgagaaagtggaagcgtcatctgcgaatttgatctgcgggatatgcgtgaatatgtcgccgtgctttcggggcgtgccaacacggtgcgctttgcaactcgactacgcgaggcacaagaaggcaactcatctggctggctcagcgaattcatggcccgtcaccacgaggcagaagattgataaggtaggaaacgatgaagacgacgcaacttattgcaacagttttgacctgcagctttctatatattcagcccgcgcgggcgcagtttgttgttagcgacccggcaacggaggctgagacgctcgcgactgcgctcgcgactgcggagaatctcactcagactatagcgatggttacgatgttgacgtcggcctacggcgttactggactactgacttcgctcaaccagaaaaatcagtatccttcgacgaaggacctagacaatgaaatgttttcgccgcgaatgccaatgtcgaccacggcacgtgcgatcaccagcgatacagatcgtgcagtcgtgggtagtgatgctgaagcggacctgttgcgatcgcagatcaccggttccgcaaacagcgctggcattgcggctgacaatctggaaacgatggacaaacgcttgacggcgaatgctgatacgtctgctcagctttcccgatctcgcaatatcatgcaggcaaccgtgaccaatggtttgcttctcaagcagatccatgacgcaatgattcaaaatgtacaggcgacaagcctattaacgatgactaccgcgcaggccggccttcacgaggcggaagaggcggccgctcaacgcaaggagcatcaaaagaccgctgtcatctttggtgccctcccctaaggctgggcgatttgttcatccgcccgcatcctcgccgaatgcgagctcattttatccaacattatgcgacaaaccagtcaagttcaggtccaatcgatgaatttcacgattccggcgccgtttacggccattcatacgatcttcgatgtagccttcacgacaggcttggactcgatgcttgagactatccaggaggcggtgagtgcgccattgatcgcctgtgtcactctttggattattgttcagggtattttagtcatacgcggcgaagtcgatacccgtagcggtatcactcgggtgatcacggtcaccatcgttgttgctctaattgttgggcaggctaactaccaagactatgtggtttccatcttcgaaaagacggtcccaaactttgttcagcagtttagtgtaaccggcttgcctctgcagactgttccggcacagttggatacaatgttcgccgtgacccaggccgtttttcagaaaatcgcatccgaaatcggtccgatgaacgaccaggacatccttgctttccaaggggcacagtgggtcctttacggcacgctctggtctgccttcggagtttacgacgccgttggaattctcacgaaagtgcttctcgcgatcgggcctctgatcctcgtcggatatatttttgatcgcacgcgggacatcgcagctaagtggatcgggcaacttatcacctacggtctcttgcttctcctcttaaacctcgtggcaacgatcgtcatcctaaccgaagcgactgcgctcacccttatgcttggtgtaatcaccttcgccggtacgaccgcggccaagatcattggtctttacgaactcgatatgttttttctgacaggggatgcgctcattgtcgctttgccggcgatcgccggcaacattggaggcagttactggagcggcgcaacccaatctgccagcagcttgtaccgtcgcttcgctcaggttgagcgaggctaggtcgcgcaaaaattcgcctcaatggagaattctatgaagtattgcctgctgtgcctagttgtcgctttgagcggctgccagacaaacgacacattagcgagctgcaaaggcccgatcttcccgctgaatgtggggcgatggcagcctactccgtcagatcttcagctcggcaattcgggtggacgctatgacggggcctgaatatgccatgctagtggcgcgcgaaagccttgccgagcactataaggaagtagaagcctttcaaaccgcgcgagcgaaatcggcgcgacgtctctccaaactcattgcagctgtcgcagctatcgcgattttgggaaatgttgctcaagcgttcgctatagccacaatggtgccgttgagcaggcttgtgcccgtatatctatggatacggccggacggcaccgttgacagcgaggtgtctgtctcgcgattgcctgcaactcaagaggaggccgtcgttaacgcctcattgtgggagtacgttcgcctgcgcgagagttatgatgccgacaccgctcagtacgcctacgacctggtatcgaacttcagtgccccaacagtgcgccaggattaccagcaattcttcaactatcccaatcccagttcgcctcaagtcattcttggcaaacgcggcagggtggaggtcgagcacatcgcttcaaatgatgtaactccaagcacgcagcaaattcgctataaaaggaccctcgtcgttgacggcaaaatgcctgtggtgagtacgtggaccgcgacagttcgctacgaaaaggtgaccagcttgcccggcagattgagactaaccaacccggcaggtctggttgtcacctcctatcagacatcggaagataccgtttcaaacgtaggccacagcgaaccatgatcagaaaagcacttttcattttagcatgtttatttgccgctgcgactggtgcggaggctgaagacactccaatggcgggcaagctagatccgcgcatgcgttatttggcttacaatcccgatcaagtggtgcgcctctcgacggcggttggagctactttggtcgtaacattcgccacgaacgaaacggtgacagcggttgccgtttcaaatagcaaagatctagcagccctaccgcggggaaattatctatttttcaaggcaagccaggtcctcacgcctcagccagtaatcgtgctaaccgcaagcgactccgggatgcgccgttatgttttcagtataagttccaagactctgtcccacctcgataaagagcagcccgatctctattacagcgtccaattcgcctaccccgccgacgatgcggcggctcggcgaagggaggcacaacagaaggctgttgtggacagactacacgcggaagcacaatatcaacggaaagctgagaatttattggatcagcctgtcacagcccttggtgcggcggacagtaattggcactacgtcgcccaaggcgatcgttcgctgttgccactcgaagtcttcgacaatggatttacgacggtattccactttccgggcaatgtacgcataccctccatctacaccatcaatcctgatggcaaggaagctgttgccaactattcagttaaagggagcgatgtcgagatttcttcggtttcccgaggttggcgtctgagggatggccacacagtactatgtatctggaacaccgcttacgatcccgttggccaaaggccgcaaacgggcacggtgaggcccgatgtgaaacgcgtcctgaagggggcgaagggatgaataacgatagtcagcaagcggcacatgaggttgatgcatctggatccctggtctccgacaaacatcgccggcgtctttcggggtctcagaaattgatcgtcggaggtgtcgttctcgcgttatcattaagcctcatttggctaggtgggcgccaaaagaaggtgaatgagaacgcatcgccgtcaactttgatcgcaacaaacaccaagccatttcatccagctccgattgaggtgccgccggatcctccagcggttcaagaggctgttcagcctgctgctcctctaccgccgaggggcgaaccggagcggcatgagccacggccggaagaaacaccgatttttgcatatagcagcggcgatcaaggggtcagcaaacgcgccattcagggcgacacgggccgaagacaagaaggcaagcgtgacgacaactccttgccgaatggcgaagtgtccggcgagaacgatttgtcgatacgtatgaaacccaccgagctgcagcccagcagcgccacgctcttgccgcaccccgattttatggtaacgcaagggacaataattccgtgcatcttgcaaaccgcaatcgacacaaatttggcaggctatgtaaagtgtgtcttgcctcaggatattcgtggaacaacgaacaatatcgtgcttcttgatcgtggcaccaccgttgttggcgaaatacagcgtggcttgcaacagggagatgggcgcgtttttgtgttgtgggatcgcgccgagacacctgaccatgcgatgatctcgttaacatcgccaagcgcggacgaactcggtcgctcaggattgccgggctcggtcgacagccacttctggcagcgttttagcggagctatgctcttgagtgttgttcaaggcgccttccaggcagctagcacctacgccggcagctcgggtggcgggatgagcttcaacagctttcaaaataacggtgagcagacaactgagacagcccttaaggcaaccatcaacataccgccaaccctgaagaagaatcagggtgacaccgtttccattttcgtagcacgggacctcgatttctttggtgtttaccagctccgcctgactggcggcgccacgcgggggaggaaccgccgctcttaatgaattcaaatttccgcttagagataggatacattgtaaatggaagtggatccgcaactacgctttcttctgaagccgattttggaatggctcgatgacccgaagactgaagaaattgcgatcaatcgacctggagaggcatttgtgcgccaagccggcatttttaccaagatgcctttgcccgtctcttatgatgatcttgaagatatcgctattttagcgggcgcgctgagaaagcaggatgtcggaccacgtaaccccctctgcgccactgaacttcctggtggtgaacgactacaaatctgtctgccgccgaccgttccctcgggcaccgtcagcttgaccattcgacggccaagctcgcgtgtttctggtcttaaagaagtctcctcccgttatgatgcttcgaggtggaaccagtggcagacacgaaggaaacgccaaaatcaggatgatgaagctatccttcagcattttgacaacggggatttggaagcgtttctgcacgcatgcgtcgtcagccgactgacgatgttgctatgtggccctaccggaagcggcaagacaacaatgagcaagaccttgatcagcgccatccccccccaggaaaggctaatcaccatagaagatacgctcgaactcgtcattccacacgataatcatgttagactactctactccaagaacggtgctgggctgggtgctgtgagcgccgagcacttgctccaagcaagtctgcgtatgcggccggaccggatattgcttggcgagatgcgcgacgatgcagcatgggcttatctgagtgaagtcgtctcgggacatccgggatcgatttcaacaatacacggcgcgaatccaatccaaggattcaagaaactgttttcccttgtcaaaagtagcgcccaaggtgctagcttggaagatcgcacactgattgacatgctctctacggcgatcgatgtcatcattccattccgtgcctatgaggacgtttatgaagtaggcgagatctggctcgcggcggacgcacgacgccggggcgagaccataggcgatctccttaatcaatagtagctgtaacctcgaagcgtttcacttgtaacaacgattgagaacttttgtcataaaattgaaatacttggttcgcattttcgtcatccgcggtcagccgcaattctgacgaactgcccatttagctggagatgattgtacatccttcacgtgaaaatttctcaagcgctgtgaacaagggttcagattttagattgagaggtgagccgttgaaacacgttcttcttatcgatgacgatgtcgctatgcggcatcttattatcgaataccttacgatccacgccttcaaagtgaccgcggtagccgacagcacccagttcactagagtactctcttccgcgacggtcgatgtcgtggttgttgatctaaatttaggtcgtgaagatgggcttgagatcgttcgaaatctggcggcaaagtctgatattccaatcataattatcagtggcgaccgccttgaggagacggataaagttgttgcactcgagctaggagcaagtgattttatcgctaagccgtttagtacgagagagtttcttgcacgcattcgggttgccttgcgcgtgcgccccaacgttgtccgctccaaagaccgacggtctttttgttttactgactggacacttaatctcaggcaacgtcgcttgatgtccgaagctggcggtgaggtgaaacttacggcaggtgagttcaatcttctcctcgcgtttttagagaaaccccgcgacgttctatcgcgcgagcaacttctcattgccagtcgagtacgcgacgaggaggtttacgacaggagtatagatgttctcattttgcggctgcgccgcaaacttgaggcggatccgtcaagccctcaactgataaaaacagcaagaggtgccggttatttctttgacgcggacgtgcaggtttcgcacggggggacgatggcagcctgagccaattgcatttgattaatttaggtgactgaggacgcggccagcggcctcaaacctacactcaatatttggtgaggggttccgataggtccctcttcaccaattgctcgatggcttctctccagcaaagaatgacgcgagcgcggcggtagccagcttgtggccgaaagctcgagcggtctccaaccccaacggatcaaaatgacttcgagcgacctcgagcaacgcaaccgggaacatgcgtgaggtctgaacgagaacggatttttctgtagttgaagggatcggataacttttcggggccacgcgaaatgatccatctgccagcatgctttcgaaatcgtccaacgcgcgccttaaaatcatttgtagcgacttcgagggactgtattgccgaacgaggttgtcatatgttttcgacacttgaggcgcgggcggtcgcgctgaaagaaaaacctggagctttttcggggacggaggtggactaagggcatccacagttagcttaagttgtcgatcgggactgtaaatgtgatcggcgacgagaggctcacgttgctggtctttctcgtcggctttttcaggcaagtgctggaggtccagcttctggggaacaagtgtcgggttgggatggtggatctcgggtcgagcaccagcaagccgccgtgcttcgccgaccgacaatgcgggcttgcgaattgccatcttcaagcctccaagattttgctgatcagtttcgaaatgaccacgacttcctccatcgcaatccgaagattcctctctatgaggcgcatcgtcggatcagttcccgtgtttagtaatgtaagatgcaacatgccgcgttctttcatcgcggcaaatgcatctctttcatgcatgggagacggtacaactggaaggctctctagcgtctctgacatcctgcgttgcgatgttgtcaatcggccgaccgggacgcgttggcgcaaaacagctgtaggaattgccaaattttcactcaacagcagctcgatgacgtagcggtaggtagatagtgcctcatcgatgtcgagcggcgttagcatggtggggatcagaagcaggtttgagctagcgatgattgtgttgttgagctcgctcgagccgccacgcgtatcggccaacgcataatcaaatccttcgagctcggcattttcataggctgcttcaagaaggggcatttcgtcggcggaatagacttcacagcgaggatcccaggtactgctttgtaaggcgttttctctccatcgcgtcagaggccggttttcgtcggcatcaaagagggccactcgtttaccgtcatttgccaaagcagcgcaaaggcccatgagtgcggtggttttgccagcaccccctttgaaagaacaaaacgtcaaaagttgcatattctgatcccgcctatcctgtgaaaccggagtgcatttgtatttttgttcgtataaatgtttttgtgattatcgatgagtaaaagcgttgttacactatttttatttcacattcgttataagacaattgcaaatgtagcaagtatattcagtattgactgtaaatgtactgttgatttcatattgagcagggctagacttccatccgtctacccgggcacatttcgtgctggagtatccagaccttccgctttctttggaggaagctatgtcaaaacacaccagagccacgtcgagtgagactaccatcaaccagcatcgatccctgaaagttgaagggttcaaggtcgtgagtgcccgtctgcgatcggccgagtatgaaaccttttcctatcaagcgcgcctgctgggactttcggatagtatggcaattcgcgttgcggtgcgccgcatcgggggctttctcgaaatagatgcagacacacgagaaaagatggaagccatacttcagtccatcggaatactctcaagcaatgtatccatgcttctatctgcctacgccgaagaccctcgatcggatctggaggctgtgcgagatgaacgtattgcttttggcgaggctttcgccgccctcgatggactactgcgctccattttgtccgtatcccggcgacggatcgacggtcgctcgttactgaaaggtgccttgtagcacttgaccacgcacctgacgggagaaaattggatgcccgatcgcgctcaagtaatcattcgcattgtgccaggaggtggaaccaagacccttcagcagataatcaatcagctggagtacctgtcccgaaagggaaagctggaactgcagcgttcagcccggcatctcgatattcccgttccgccggatcaaatccgtgagcttgcccaaagctgggttacggaggccgggatttatgacgaaagtcagtcagacgatgacaggcaacaagacttaacaacacacattattgtaagcttccccgcaggtaccgaccaaaccgcagcttatgaagcaagccgggaatgggcagccgagatgtttgggtcaggatacgggggtggccgctataactatctgacagcctaccacgtcgaccgcgatcatccacatttacatgtcgtggtcaatcgtcgggaacttctggggcaggggtggctgaaaatatccaggcgccatccccagctgaattatgacggcttacggaaaaagatggcagagatttcacttcgtcacggcatagtcctggatgcgacttcgcgagcagaaaggggaatagcagagcgaccaatcacatatgctgaatatcgacgccttgagcggatgcaggctcaaaagattcaattcgaagatacagattttgatgagacctcgcctgaggaagatcgtcgggacctcagtcaatcgttcgatccatttcgatcggacgcatctgccggcgaaccggaccgtgcaacccgacatgacaaacaaccgcttgaaccgcacgcccgtttccaggagcccgccggctccagcatcaaagccgacgcacggatccgcgtaccattggagagcgagcggggtgcccaaccatccgcgtccaaaatccctgtaactgggcatttcgggattgagacttcgtatgtcgctgaagccagcgtgcccaaacaaagcggcaattccgatacttctcgcccggtgactgacgttgccatgcacacagtcgagcgccagcagcgatcaaaacgacgtcatgacgaggaggcaggtccgagcggagcaaaccgtaaaagattgaaggccgcgcaagttgattccgaggcaaatgtcggtgagcccgacggtcgcgatgacagcaacaaggcggctgatccggtgtctgcttccatccgtaccgagcaaccggaagcttctccaacgtgtccgcgtgaccgtcacgatggagaattgggagaacgcaaacgtgcaagaggtaatcgtcgcgacgatgggcgcggggggacctagactagtagacaggaaggaccgaataatggcaaatggtcagttcacgatacgctctgctcgcccggcctccgtcggactgacaggcgaacggcgtggagccgcatccgcctctagctctgcactgtccaatgttcaaagagatgttagggataggctgattccaactagctcaccaagattaccaaatgcagccatattgcgtgattcctcgggaagagcgtcgactggtctgcggtacatggcggctactcttcattggtctgcgatcgcgccattatcgctaataaacagcaacgacctggctccggccgcttatgactttgagacgcgaaataacgcaagaaatgtgactgccaaagtcggcagggcagtccctgttcccaagcaaggcgggctcggcaaaacgctcgcacccgtaccccttagtacacgtatatcaagggtcaattccgaccgaagactgcccgctgacgcagaagaccgccctgaaacgcgcgacccccagaaaggacgtggcagtcatggtgcgacgccaaccttacatgaaaagattggaaccgcgtttgctcgaagattgcgaaagcatacgtactatattgtttgcagttgctgccagacccggagcgcgttgacgatgggtgcaaagatttcggtgaagtcatgaactccagcaagacttcgccccagcgtatgaccctgagcatcgtatgttcgctggcagccggtttttgtgcggccagctgctatgtaacgttccgccggggcttcaacggcgaagcgatgatgacgttcgacgttttcgctttttggtatgagaccccgctttacttgggttatgccagcaccgtcttctggcgtggtttatctgttgtcatctttacctcgctgatcgttctttcaagtcagctcatcatatcgctgcgcaatcagaagcatcatgggacagctcgttgggcagaaattggcgaaatgcggcatgctggttatctgcagcgttacagtcgcatcaaggggccgatctttggaaagacatgtggtcccctttggttcggcagttatttgaccaatggcgaacagccacacagtcttgtcgtcgcgccaacgcgtgctggcaaaggcgtcggcatcgtcattccaacgctgttgaccttcaagggctcggtaatcgcccttgacgtcaagggagaattgtttgaactgacgtccagagcacgcaaagcgagcggcgacgcagttttcaagttctcccccctagatcctgagcggaagactcattgttacaatccggtcctggatattgccgcacttccgcccgaacgccagttcactgaaacacgccgtctagctgcgaaccttattacggctaagggaaagggagcagaaggctttattgacggcgcacgtgacctgttcgtcgcgggaatccttacctgcattgagcgtggcacaccaacgattggcgcggtatatgacctatttgcgcagcctggcgaaaagtataagctttttgcgcaactcgcggaggaaagcctaaacaaagaggctcagcgtatcttcgataatatggcgggcaacgacacgaaaattctgacatcgtacacctctgtgctgggcgacggtggactgaacctgtgggctgatccgcttatcaaagcagcgacaagccggtcagacttttccgtttacgatctccggaggaagaagacctgcatttatctttgtgtcagtcccaacgatctggaggtcttggcaccacttatgcgcctgatgtttcagcagctcgtgtcaatcttgcagagatcgctgccaggtgaagacgagtgccatgaagttttatttctcctcgacgaattcaaacacctgggcaagcttgaggccatagagaccgcgatcacaaccatcgccggttacagaggccgctttatgtttattattcaaagtctttcggccttgtcgggcacatacgatgacgcaggaaaacaaaactttctgagcaatactggcgtacaagtatttatggccacggctgatgacgaaactccaacctacatctcaaaagctatcggcgaatatacgtttaaagcgcgttcgacctcttacagtcaagccagaatgttcgaccacaacatccagatttctgatcaaggtgcagcccttttgcgccccgaacaagtgcgcctgctagacgatcagagtgaaatcgttctcatcaaagggcgacctccactcaaattacgaaaggtgcagtattattccgatcgtacgctgaaaggccttttcgaacgccagatgggctctctgcctgagcccgcacccttgatgctttccgactatagcaacgatcaagttcaataccacttggctccgatagcaaattttaatgaggatgctgcaccgcaaaacagaactgtggccgaggaccatggaagtgttaaagtcggtgctgatatccctgaacgcgtgatgggaataaatggtgacgaggaacaagccgatgcgggcgagataccgccggaatcggttgtgcctccagaattgacgctcgctctgaccgctcaacagcaattgttggaccagattattgcacttcagcaaagatcgaggtccgcaccggcatagcctgcgaaatgatcttaatggtgcaattcgtttcaggcggcatgttgcggttcaacaaagtgtacgccagatcccaattggccctttacgaggtgtcggtatgacaggaaagtcgaaagttcacataagaggttcggctgacgcgcttcctgacgttcctggcggaagtactaccgccccttttttaaccgaaccttctcgggatcaggttgatgcctcgtttgaggtccaaaccgactacagccagtctacttccgtgtcgtttacctatgatggtgttggacttggtcctgccgagcgtgcggcttacgagaactggtgcgaaccgggccggcccacttggaaagatcttataatcaaggcacgtgtcgatccgattgacgatgtgacctggctccgagatttagaagaggacaccccctcaaccttcagatacgaagggatgcctctgggcatcggggaacgacaggcctacgaaaattggcaagaggacgctcagccgacatgggaagaccttgttgtcagcgcacgcttgacggaacttggccgtccacacgggattaccggcgagtatacatccctcgcaggatcgaagaatacaagttcaatttcattgaagcgaaagcggagcaacttaattgatgatgagaattcatccggatcgttttcatatgacgggatgaagctcggggaagccgagcgttctgcatatggtgactgggccgaggcggagccacccacgtggaaagatttggtattgagggcacgcgtttcctcgatcaatgactctgcttggctttttgattcacaaacatcttcatcatcatttgaatacaacggtgttcccttgggcgagccggaacggcaggctctcagacaatggcaaggagacgctcagcctacctgggaagatctcgttgttaacgcgcgtatggcagaactttgccatgctggttggattgaaggtcaaaaaggttgctttgaagagcgcggggaggctctgcccgcgtcggaacgcggttcgcaacgccccattggtcaacggacagattcctccgattcttttgtgtatgatggcacaaggctcggagcacctgagcgaactgcttatgaacgctggagtaagagggaacgcccgacttgggaagatctcatcttagatgcacaccaggccaggactgaaagtgacgctgttacgacccaagcgattggtcagtcgtcctcaccggttttcttatatgaaggaaagtcgctcggagacagggaacgaaaggcttacgaaaaatggcggcagccagcccaaccgcgatggcaaaatcttgtagtgaacgctcgtctggcagaaatcgatccctcagcctggattgccgatgagcgcgatccgcttgatgatagcgacgcgcttggtcgcccgtcgtacacaagcttgacggatagatcagacgtccctttagacgatcaatcaatctatcgtcgttccgacctagtaagggagcaggtgccagaatcgtctcaaaggcaattcgcagcatgttcagaatctgaaacgaggcctgtgcaatggtttactgcttctgggtcagatgcaaacaatacggaaaatatcaccgccagcgatcccgtcgatcgcacgggtggagttaagcggctaggctccaaaagcgacagaaccgttacagcttctatccatgacgtgaattccagcacaaggcgactgttgcttaacgaatttggatcggaggctccgcgcccttcgccagaaaagactgttcgcttaagaagcgacaatattggcacctatgggagccggaaaaatgaacgagcgcggctcgcgaccgaaaccggtgcgtatgagtcggagcatattttcgggttcaaggctgtccacgatactgcgagagcgacgaaagagggccggcgtctcgaaaggcccatgcccgcctaccttgaggataaggggcttcatcgccaacatattggcaccgggagaggacggaccaaacttgtcgggcgcggatggccggatgacacaagctatcgctcggatcaaagggcaactctgtcggaccccgttgcgcgctcggaaggcgcgacggcctcaaatgggtatcaattgaaccaattgggttacgcgcaccaactcgctagcgatggcctgcaaagtgaatcgcccgatggtgttgccttgccaattcaagtggcaacaacgagctacaactatacagtgagccgcgatcctgtccttgttccgccggataaaaacgaagcccctcaattgctgcatcttggtccccgtggtcaaaccgaagctgttcttgcccgcgaaacagcattgactggaaaatggccgactctcgagcgtgagcagcaagtgtatcgcgagtttttggccttatatgacgtaaaaaaagatcttgaggccaaatcagtcggcgtaagacggaaaaaaaaagaagttatttctgcgttagaccgaactgcgcgcttgataagcacgtcgccttcgaaagctcgatccaaagcagagactgaaaaagccattgatgagctcgatgatcgacgagtttatgatccgcgtgatcgagctcaagacaaagcgtttaaacgctgataagtcgccaatatagtgatcatttgcagtattcgcatcgatcgctggttgatattctgccgctggtcgaccggctgctcgtcgccaaaaatgctcacagggatacgatggcctcggtcaggccgcgtgcgtcctgtctttccagttcctccctttcagctcgattgtggcatcatttattgcctgctcattgcagttgaaacgcgatatccgtttcaagacccgggtatggatggtactttggagatatgagcacttgccagacttcccggtcggagacttaaaaattccgataagaggttacggacgacggaccttataagtggatcgtctagtggtggcgccgatcaaaacagttccgcccccggctttgctcaaagtagcaaagcagctttatctcgggttgcggaggattttctagaaaaccgcaattttgcaggagagaacatatggccatcatcaagccgcatgtgaacaaaaataggacaacctcgccgatagagagaccggagtctctcatagaggaaatgagcggcagtcatccgccgagtggttttaccaacctggatctcgctatgatcgagctggaggactttgtccatcggtgcccgctcccagaagacaatcttgctggtcagaaggagtgagacgatggatccgtctagcaatgagaatgtctatgtgggtcgcggtcacaacatcgaaaatgatgatgacactgaccccaggcgttggaagaaggcgaatatcagttccaacaccatctccgatattcagatgacgaatggcgaagacgtacaatcagggagccctacccgaacggaagttgtaagcccacgtctggattatggatcggtcgactcctcctccagcctttattctggcagcgagcacggaaatcaagctgagattcaaaaagagctgtccgtcttgttctcgaacatgtctttgccaggcaacgatcggcgcccggacgaatacattctcgtgcatcaaacgggacaagatgcttttactggtattgccaaaggcaacctcgaccaaatgcccaccaaggcggaatttaacgcgtgctgccgtctctacagggacggagccggtaattactacccgccacctctcgcattcgacaagattagcgttccagagcaactggaggaaaaatgggggatgatggaggcgaaggaacgtaacaaactgcggtttcagtacaagttggacgtatggaatcatgcgcacgctgatatggggatcacgggcacagagatcttttatcaaacagataagaacataaagctcgaccggaattataaactaagacctgaagaccgatacgtacaaacagaaaaatacgggcgccgggaaattcaaaagcgatatcaacacgaactccaggctggttcgctgctgcccgatattatgatcaaaactccccaaaatgacatccacttcgtgtacaggtttgccggcgacaattacgccaacaaacagttcagcgagtttgaacacaccgtcaagcgcaggtatggcgacgagactgagatcaaattgaagtcaaagtcaggcattatgcatgactcgaaatatctggaatcctgggaacggggcagtgcggatattcgcttcgcggaattcgttggggaaaatagagctcacaatcggcagtttccaactgcgacagtaaatatgggacagcagccagacgggcagggcggtttgacccgcgaccgtcatgtgagcgttgacttcctaatgcaaagcgcacccaattcgccttgggcgcaagctttgaaaaagggagaactgtgggatcgcgttcagttgcttgctcgcgacggcaaccgctatctgtcgccgcccagattggaatattctgaccctgcacatttcaccgagttgatgaaccgggttggtttacccgcatcgatgggtcggcaaagccatgcggctagtatcaaattcgaaaagtttgacgcgcaggcagcggttattgtcttaaatggcccagagttacgtgacattcatgacttgtctcctgaaaaactgcaaaatttgtccaccaaagatgtcatcgtcgccgatcgcaatgagaatggtcagagaactggcacgtacaccagcgtcgcggaatatgagcgcttgcagttaaggctgccacccgatgcagcgggggtgcttggtgaagcaactgacaaatattcacgtgatttcgttcggccagagccggcgtcgcgtccaatcagtgacagccgcaggatatacgaaagtcgaccgcgtagccaaagcgtcaacagcttttgacgttcctgctgccgcgtcaacgaggaagctcgtttgacccgggtttgccaatgaaagggctcaatcatggtgaacactacaaagaaaagttttgcgaagtcgcttacggcagatatgcgccgttctgctcagcgcgttgtcgagcaaatgcgaaaagcattgattaccgaagaagaggcgctcaagcggcaagccagactggagagtcccgataggaagcgaaagtatgctgctgatatggcgatagtcgacaaactcgacgtagggtttcgaggcgaaataggctataaaattcttggaaataaccggcttcgagtagacaaccataaagaattaacgcgtgagcacggtagacttcgcaaaaccaaaacggttctgaagcgtaacccggtgacgcaggaagtctatttgggtttatatgaaaggaagtcctggttaagtgtcagcagccatttgtatgctgcggacggcacactccgcatgaagcacgtgaaatacaaagacggacgttttgaggaaaaatgggagcgcgacgaaaatggcgacctgatccgcacaaggtacgccaaccgtggcaggctctttcaacctgtatccgagaaaatgggcgcgccgtatcggagcggccctgacgaccggctctatcgcgatctaacccgtcgaaacggtttcagacgggagacattcgaacgggacgatcacggaaacctcgagcgtatcggcagcaaccatgtcggcttttccaagatttcagtgaaggcacccaatcgtcaaacctcccagacgaagattcaaaaacttggtggcgctttcaacaaatcttttaggtcccttctggacaaggagggcaatgaaatgggccgcgatattttgagccatcgacggctctataacaagcggtctgctgtctacgatgaagctaccggacaattgaagagtgccaagcataccttcggcaagatctacaggagcgaaaccgaatatctcagcgcgggcctcaagaaggtttcaaaaaagatactcggggtgacggtctaccggaaatttgcggcgctcagcgagcgagaatccgaggctgagagactgcgtagttttgaatccggtgcgcatcgccagatctggcaggagcgggcagcgattcccggttcgcccctcccggagactgatgacattcatttcgcacagcagtcgcacctagccaaagccaaccctgatcacgtcgaagctgacgtcacgcgtgtgacagatcaacatgttgatgttgctggacaaacatcatcgtctccccaacggaacttggaaggatggttagattctcaatcacgatacaagccagcaaacatgctgttgtcaaatccagaccttcaagcgaacggacctcgcccatacgaagggttagctcatctcaccctccggcgcgataatgaatctgacgggcacaaggagaatgatcagcggctgcgacatttctcccagccagagccgttggtgttaccgcatcccgggtcgccggaaataactaaggtgtttggctcgcggggagagccggcacacccgagtggaaatctgcacacggcggttggagaaacggcttgcgaaggaccggtgatgtcttcatcctcggacaatcatcagccagctccaggacagcaagaacttttaagtttccttcataatgcgccagccccagtttctgtggcaatacatgatgatcaagagcgacttgcgggggaggcgcccggcggctctttcagaggtagctcagggcgaacgagttcaatgtcggagagtatcttcgacgaagatgtacaagggcatttggtacgggattattcgatcaatactactaacgggtttattgacccgcaatcgttgttcggtgaaccggacttatcgagaggtccaaaatcggggccagaaattccatcggaagattaccatttgtcagcttcggaacaggaaaatttgctgaatcaattgcttagtgtgccactgccggttccttcaccgaagcccgaatgcgcgaggtctatgattttcgaaggttcacgttcaagagagcgttccacctccagagggttctaaggtggaacgcgtctaggcttgcctatcatcaccacctcatgatggtcgcggagaccttcgaagagatatccgacatcattggagaagctgggccggaaactagtgtacctcgcgaatgcatctagatccaatccaatatgcatggcatgccgaatccatgtgggagtttattcttgacacagatatttatgatataataactgagtaagcttaacataaggaggaaaaacatatgttacgcagcagcaacgatgttacgcagcagggcagtcgccctaaaacaaagttaggtggctcaagtatgggcatcattcgcacatgtaggctcggccctgaccaagtcaaatccatgcgggctgctcttgatcttttcggtcgtgagttcggagacgtagccacctactcccaacatcagccggactccgattacctcgggaacttgctccgtagtaagacattcatcgcgcttgctgccttcgaccaagaagcggttgttggcgctctcgcggcttacgttctgcccaagtttgagcagccgcgtagtgagatctatatctatgatctcgcagtctccggcgagcaccggaggcagggcattgccaccgcgctcatcaatctcctcaagcatgaggccaacgcgcttggtgcttatgtgatctacgtgcaagcagattacggtgacgatcccgcagtggctctctatacaaagttgggcatacgggaagaagtgatgcactttgatatcgacccaagtaccgccacctaataatgtctaacaattcgttcaagccgacgccgcttcgcggcgcggcttaactcaagcgttagatgcactatacgtaccaatccaaatcggatccccctgcagggctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagcagatctatcgatggtacctatctgcagacggaagggattcctgttaattaaaacagcttgcgtcatgcggtcgctgcgtatatgatgcgatgagtaaataaacaaatacgcaaggggaacgcatgaaggttatcgctgtacttaaccagaaaggcgggtcaggcaagacgaccatcgcaacccatctagcccgcgccctgcaactcgccggggccgatgttctgttagtcgattccgatccccagggcagtgcccgcgattgggcggccgtgcgggaagatcaaccgctaaccgttgtcggcatcgaccgcccgacgattgaccgcgacgtgaaggccatcggccggcgcgacttcgtagtgatcgacggagcgccccaggcggcggacttggctgtgtccgcgatcaaggcagccgacttcgtgctgattccggtgcagccaagcccttacgacatatgggccaccgccgacctggtggagctggttaagcagcgcattgaggtcacggatggaaggctacaagcggcctttgtcgtgtcgcgggcgatcaaaggcacgcgcatcggcggtgaggttgccgaggcgctggccgggtacgagctgcccattcttgagtcccgtatcacgcagcgcgtgagctacccaggcactgccgccgccggcacaaccgttcttgaatcagaacccgagggcgacgctgcccgcgaggtccaggcgctggccgctgaaattaaatcaaaactcatttgagttaatgaggtaaagagaaaatgagcaaaagcacaaacacgctaagtgccggccgtccgagcgcacgcagcagcaaggctgcaacgttggccagcctcgcagacacgccagccatgaagcgggtcaactttcagttgccggcggaggatcacaccaagctgaagatgtacgcggtacgccaaggcaagaccattaccgagctgctatctgaatacatcgcgcagctaccagagtaaatgagcaaatgaataaatgagtagatgaattttagcggctaaaggaggcggcatggaaaatcaagaacaaccaggcaccgacgccgtggaatgccccatgtgtggaggaacgggcggttggccaggcgtaagcggctgggttgcctgccggccctgcaatggcactggaacccccaagcccgaggaatcggcgtgagcggtcgcaaaccatccggcccggtacaaatcggcgcggcgctgggtgatgacctggtggagaagttgaaggcagcgcaggccgcccagcggcaacgcatcgaggcagaagcacgccccggtgaatcgtggcaagcagccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggcaggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctagctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagccgaagagctgcaaaaagcgcctacccttcggtcgctgcgctccctacgccccgccgcttcgcgtcggcctatgcatataattgtggtttcaaaatcggctccgtcgatactatgttatacgccaactctgaaaacaactttgaaaaagctgttttctggtattt

SEQ ID NO: 36 - DNA, 31939 bp, Artificial sequence
  Synthetic construct
cgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagcagatctatcgatggtacctatctgcagacggaagggattcctgttaattaaaacagcttgcgtcatgcggtcgctgcgtatatgatgcgatgagtaaataaacaaatacgcaaggggaacgcatgaaggttatcgctgtacttaaccagaaaggcgggtcaggcaagacgaccatcgcaacccatctagcccgcgccctgcaactcgccggggccgatgttctgttagtcgattccgatccccagggcagtgcccgcgattgggcggccgtgcgggaagatcaaccgctaaccgttgtcggcatcgaccgcccgacgattgaccgcgacgtgaaggccatcggccggcgcgacttcgtagtgatcgacggagcgccccaggcggcggacttggctgtgtccgcgatcaaggcagccgacttcgtgctgattccggtgcagccaagcccttacgacatatgggccaccgccgacctggtggagctggttaagcagcgcattgaggtcacggatggaaggctacaagcggcctttgtcgtgtcgcgggcgatcaaaggcacgcgcatcggcggtgaggttgccgaggcgctggccgggtacgagctgcccattcttgagtcccgtatcacgcagcgcgtgagctacccaggcactgccgccgccggcacaaccgttcttgaatcagaacccgagggcgacgctgcccgcgaggtccaggcgctggccgctgaaattaaatcaaaactcatttgagttaatgaggtaaagagaaaatgagcaaaagcacaaacacgctaagtgccggccgtccgagcgcacgcagcagcaaggctgcaacgttggccagcctcgcagacacgccagccatgaagcgggtcaactttcagttgccggcggaggatcacaccaagctgaagatgtacgcggtacgccaaggcaagaccattaccgagctgctatctgaatacatcgcgcagctaccagagtaaatgagcaaatgaataaatgagtagatgaattttagcggctaaaggaggcggcatggaaaatcaagaacaaccaggcaccgacgccgtggaatgccccatgtgtggaggaacgggcggttggccaggcgtaagcggctgggttgcctgccggccctgcaatggcactggaacccccaagcccgaggaatcggcgtgagcggtcgcaaaccatccggcccggtacaaatcggcgcggcgctgggtgatgacctggtggagaagttgaaggcagcgcaggccgcccagcggcaacgcatcgaggcagaagcacgccccggtgaatcgtggcaagcagccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggcaggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctagctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagccgaagagctgcaaaaagcgcctacccttcggtcgctgcgctccctacgccccgccgcttcgcgtcggcctatgcatataattgtggtttcaaaatcggctccgtcgatactatgttatacgccaactctgaaaacaactttgaaaaagctgttttctggtatttaaatcctaggaaatatcagccgcttgtgtgttcaattcttctctgtttcacttgaaacaaattgaatagatattcccgctttcaaagccatttacaaatcctctcgtgcagcctaacgccattggcgtggaacaagcgttggcacgaggaagtaagtgcgatgaacggaaggtattcaccgacgcggcaggattttaagacaggcgcgaagccttggtctatattagcccttatcgttgccgcaatgattttcgcgttcatggcggttgcgtcctggcaggacaatgggactacccaggcaatccttagccaaatacgatcgattaacgctgacagcgcctcactgcagcgcgatgtactccgcgctcacacgggcaccgtggcgaactaccgccccattatctccaggctgggagctctgcggaagaatctggaagatttgaagcaattatttaggcaatctcatattgtaagtgagagcaatgctgctcaactgctacgccggctagaagtgtctctaaattcggctgacgcggcggtcgccgcctttggtgcgcaaaatgtccgcctgcaagattcgctggccagtttcactcgtgctttaagcaatcttccaggaaaggcctcaggcgatcagactttagaaaaaccaacagaattggctagcatgatgctccaatttcttcggcaaccaagcccggctatttcattcgagatcagccttgaactagagaggctccaaaaacaacgcggtcttgatgaagctcccgtgcgcatactttcgcgtgaaggtcccattatcttatcgcttttgccacaggtgaacgatctggtgaacatgattcagacgtctgacaccgcagaaattgcggaaatgttgcagcgtgagtgtttggaggtctatagcttgaaaaatgtggaggagcggagcgcacgtatctttcttgggtccgcttcagtgggtctttgcctgtacatcatcaccttagtctataggctacgcaaaaaaaccgattggttagcgcggcgtttagattacgaagagctaatcaaagagatcggagtatgttttgaaggtgaggcggccactacgtcgtccgcgcaagctgcacttggtattattcagcgcttctttgatgccgatacgtgcgcgttagctctagtggaccatgaccgtaggtgggctgtcgaaacattcggtgcgaagcacccaaaacccgtgtgggacgacagggtgctacgcgaaatagtctctcgtaccaaagcgaacgaacgggcgacggtattccgcatcgtatcgacgcaaaaaatcgtacatttgcctcccgaaattccaggtctttcgatactactggctcacaaatccacagataaactaattgcggtttgttcactgggttaccaaagctatcgccctcgaccttgccaaggcgaaattcagcttcttgaactcgccaccgcctgcctctgtcactatatcgatgttcggcgtaagcagaccgaatgcgacgttttggccagacgattggagcatgcgcaacgccttgaggcagttggtacacttgccggcggaatagcacatgaatttaataacattttggggtcaatcctcgggcacgcagaattggcccaaaactcggtgtctcgaacatctgtcacccgaagatacattgactatatcatttcgtcaggcgacagagccatgctcattatcgatcagatcttgacgctgagccgaaaacaagagcgcgtgatcaagccatttagtgtctcagagcttgtgaccgaaatcgctcccttgctacgtatggctcttcccccaaccatcgagcttagtttcagatttgatcaaatgcagagcgtgatcgaaggaagcccgcttgaacttcaacaggtactaattaacctctgcaagaatgcttcccaagccatgactgcaaatggtcaaatcgacatcttcgtcggccaagcttatttaccagctaagaaaattctggcgcatggtgttatgccacctggcgactatgttctactatctgtcagcgacaatggtggaggcatttcagaggctgtgctaccctacatttttgaacccttctttacgacacgtgctcgcaacggtggaacgggtctcggcctcgcttctgtgcatggtcatatcagcgcgtttgcaggttacatcgacgttagttcaactgttgggcatgggacgcgctttgacatttatctccctccgtcttctaaggagcccgtcaatcccgacagctttttcggccgcaataaggcaccgcgtggaaacggggagattgtggcacttgttgagcccgatgacctcctgcgggaggcgtatgaagacaagatcgccgctctgggatatgagccggtcggttttcgtacctttagtgaaattcgcgattggatttcaaaaggcaatgaagccgatctggtcatggtcgaccaagcgtctcttcctgaagatcaaagtcctaattccgtggatttagtgctcaagaccgcctccatcatcattggcggaaatgatctcaaaatgcccctttcaagggagaatgcgaccagggacctttatctgccgaagccgatatcgtccagaactatggcgcatgcaatcctaaccaaaatcaagacgtagagttgcgacgtatcaggactgggcaatcgcggccgccgggcttacgtgtcttttgtaacaaattgcgacgcagttgatatccacttgaaacattagtccgaaattatcgagatctccgctgataaggtatcgaaatggcgataaaattggtattgatactcgtattcacactctttcccgcggcagacgctgcatatgcgaatgaccgcgccaacggtttcatgtggtcaaacgggggcgaaactggagtgaggcttcctcttcgggtgttcaatgccaagccagccaagaacacggtggcgatcatttattccggagacgctggatggcaaaatatcgatgaggcgattggtacctatctgcagacggaagggattcctgtcattggcgtcagttcacttcggtatttctggtcggagcggtccccaagcgaaactgctaaggatcttggtcacataatcgatgtctacaccaagcatttcggtgtgcagaatgttttacttgtaggatattctttcggcgcggacgtcatgccggcaagcttcaataggcttacgcttgagcaaaaaaatcgggttaagcaaatctctctcttggcattgtcacatcaagtcgactatgtcgtctcatttaggggctggctccaactcgaaacggaaggtaagggcggcaatcctctggatgatctcagatccattgaccctgcaatcgtccaatgcatgtacgggcgcgaagaccgtaataatgcttgcccatctctccgacagaccggcgcagaggtgataggcttcagcggaggccatcactttgataatgatttcaaaaaactgtctacgcgcgtcgtctcaggcctcgtggcacgcctaagtcatcagtaatctttagttcctgcaccgcgggacccgcgaggtttctcgcttcaattgaaatcataaagaagcaattgaaaattttcgagtaaccgaccctcccgataatcttcaacataaaacaacgcacttcttccaacgggagaggcggtgttagttgcgagctaaggagataaggtatgcttaagagatcggggtcgctttctcttgccttgatggtctccttctgttcgtcgagccttgccacgccactctcatctgctgagtttgaccatgttgctcgcaagtgtgccccatcagttgcgacatctacgcttgcggcgatagctaaggtggagagtcgctttgatcctttagcgattcatgacaacacgaccggcgaaacgcttcactggcaagatcacagccaagcaacccaagtcgtcaggcaccgtctcgatgcacggcattcgctggatgttggcctcatgcaaataaactctcgaaatttttctatgctcggtctgacacctgacggtgcgctccaggcgtgcacatcattatctgccgctgcaaacatgctgaaaagtcgttatgcaggcggcgaaacgattgacgagaagcaatttgcgcttcgtcgggcgatctccgcttacaacaccggtaatttcatcggcggttttgcaaacggctacgtgcgaaaagttgaaacagctgctcaatcgctggtgcccgcgttaatcgagcctccaaaagacgatcacgaggcgctaaaatccgaagagacgtgggatgtttgggggtcatatcagcgccgctcgcaggaggatggcgctggcggtttaatcgctccgccaccgccacaccaggacaacggcaaatccgcagacgacaatcaagtcttattcgacttatactaaggaggtgcgcattgatgcgatgctttgagagataccgtttacatctaaatcgcctctcgctctcgaatgcgatgatgcgcgtgatatcgagctgcgccccaagcttgtgcggtgcaattgcatggagcatttcctcatccggacccgccgcagcgcaatctgcgggtggcggcactgaccccgccacaatggttaacaatatatgcacgtttatccttggtccgttcggccagtcactcgctgttctcggcattgtcgctatcgggatctcctggatgttcgggcgggcttcgcttgggctggttgccggcgtcgtcggcggcattgttatcatgtttggggcgagcttcctcggccaaacgctcactggcggtagttgatggctgatcgtttggaagaatcgaccctttacctcgcagccacacggcccgcattgtttcttggggtgccactgacattggcagggttattcatgatgttcgccggctttgtcatcgttatcgttcagaacccgctctacgaagtcgttctcgtgccgttatggtttgcagcccggctcatcgtggagcgagactacaatgcggcgagcgtcgtcctgctatttttgcggaccgcgggaagaagcattgatagtgcagtttgggggggcgctactgttagcccaaatccaattagggttcccccacgagggagaggaatggtgtgatgctcggcgcgagtggaacgaccgaaagatccggtgagatctatctcccttatattggccacctcagcgaccatatcgtccttcttgaagacggatcgatcatgaccattgcgagaattgatggcgttgcattcgagcttgaggaaactgaaatgcgcaatgcgcgttgtcgtgcgttcaacacgctgttgcgcaatatcgctgatgatcatgtgtcaatatatgctcacctcgtacgtcatgccgacgtgccatcatcggcgccgcgacacttccgtagtgttttcgccgctagcctgaacgaagcttttgaacagcgcgtgctctccggccaactcctccgcaatgaacacttccttacgttgattgtctacccacaggcggctttagggaaggtaaagaggaggttcaccaagctaagcggaaaaagggaaaacgatctcacgggccagatcaggaacatggaagatctttggcatgttgtcgctggctctcttaaagcgtatggcctgcatcgtcttggcatccgcgagaagcagggtgtgctcttcaccgaaattggcgaagcgctacggttgatcatgactggtcggttcacaccggttccggtcgtcagcggctcactcggcgcttcgatttataccgacagagtcatttgcggcaagcgaggactcgagatcagaacgccaaaagacagttacgttggatccatctattcgtttcgcgaataccctgcaaaaacacggccgggcatgctcaacgcgctgctatccctcgattttccacttgttctcacgcagagtttttcgttcctgactcgcccgcaagcgcacgcgaaacttagcctcaaatcgagccagatgctgagttccggcgataaagccgtgactcaaatcggcaaattatccgaggctgaggacgcacttgcgagcaacgaattcgttatgggctcacatcatttgagcctttgcgtctatgcagacgatctcaatagtcttggggacaggggcgcgcgggctcggacacgaatggcggatgcaggtgccgtggttgtccaagaaggtattggtatggaagcggcctattggtcccaattgccggggaattttaagtggcgcacacgccctggcgcaatcacttcacgcaatttcgcagggtttgtctctttcgaaaactttccagagggcgccagctcaggccactggggcaacgcgattgcccgatttcgtaccaatggcggaacgcctttcgactatatcccgcatgagcacgatgttggcatgacggcaatattcgggcctatcgggaggggtaagacgacgctcatgatgtttgttctagccatgctcgaacagagcatggtcgaccgtgcaggtacggtcgtgttctttgacaaggaccggggtggcgaattgctggttcgcgccacaggaggaacatatttggcacttcacagaggcacacccagcgggttggcgccgttgcgtggcctagaaaacacagcagcctcacacgattttctgcgcgaatggatcgtggctctcatcgagagtgatggtcggggtgggatttctccggaagagaaccgccgtctggtccgtggtatccatcgtcagctctcgtttgatccacaaatgcgttcaatcgcggggttacgtgaatttttgttgcatgggcccgccgaaggcgcaggagcgcggctccaacgctggtgccggggccatgcgcttggctgggcatttgacggcgaagttgacgaagtaaagttagatccgtcgattaccggcttcgacatgacgcatcttctcgaatacgaggaagtatgcgctcccgctgcagcatatctcctgcatcggattggagccatgatcgacggccgccgttttgtgatgagctgcgatgagtttcgcgcctatttgttaaaccctaaattttcgactgtcgtcgacaaattcctcctgaccgttcgaaaaaacaacgggatgctaatactggcaacgcagcaaccagagcatgttctggaatcgccgctaggagccagcttggttgcgcaatgtatgacgaagattttctatccatcaccaaccgcagatcgatcggcttatgtcgatggactgaaatgtaccgaaaaggaatttcaggcgatccgtgaagacatgacggtcggcagccgtaagtttcttcttaaacgagaaagtggaagcgtcatctgcgaatttgatctgcgggatatgcgtgaatatgtcgccgtgctttcggggcgtgccaacacggtgcgctttgcaactcgactacgcgaggcacaagaaggcaactcatctggctggctcagcgaattcatggcccgtcaccacgaggcagaagattgataaggtaggaaacgatgaagacgacgcaacttattgcaacagttttgacctgcagctttctatatattcagcccgcgcgggcgcagtttgttgttagcgacccggcaacggaggctgagacgctcgcgactgcgctcgcgactgcggagaatctcactcagactatagcgatggttacgatgttgacgtcggcctacggcgttactggactactgacttcgctcaaccagaaaaatcagtatccttcgacgaaggacctagacaatgaaatgttttcgccgcgaatgccaatgtcgaccacggcacgtgcgatcaccagcgatacagatcgtgcagtcgtgggtagtgatgctgaagcggacctgttgcgatcgcagatcaccggttccgcaaacagcgctggcattgcggctgacaatctggaaacgatggacaaacgcttgacggcgaatgctgatacgtctgctcagctttcccgatctcgcaatatcatgcaggcaaccgtgaccaatggtttgcttctcaagcagatccatgacgcaatgattcaaaatgtacaggcgacaagcctattaacgatgactaccgcgcaggccggccttcacgaggcggaagaggcggccgctcaacgcaaggagcatcaaaagaccgctgtcatctttggtgccctcccctaaggctgggcgatttgttcatccgcccgcatcctcgccgaatgcgagctcattttatccaacattatgcgacaaaccagtcaagttcaggtccaatcgatgaatttcacgattccggcgccgtttacggccattcatacgatcttcgatgtagccttcacgacaggcttggactcgatgcttgagactatccaggaggcggtgagtgcgccattgatcgcctgtgtcactctttggattattgttcagggtattttagtcatacgcggcgaagtcgatacccgtagcggtatcactcgggtgatcacggtcaccatcgttgttgctctaattgttgggcaggctaactaccaagactatgtggtttccatcttcgaaaagacggtcccaaactttgttcagcagtttagtgtaaccggcttgcctctgcagactgttccggcacagttggatacaatgttcgccgtgacccaggccgtttttcagaaaatcgcatccgaaatcggtccgatgaacgaccaggacatccttgctttccaaggggcacagtgggtcctttacggcacgctctggtctgccttcggagtttacgacgccgttggaattctcacgaaagtgcttctcgcgatcgggcctctgatcctcgtcggatatatttttgatcgcacgcgggacatcgcagctaagtggatcgggcaacttatcacctacggtctcttgcttctcctcttaaacctcgtggcaacgatcgtcatcctaaccgaagcgactgcgctcacccttatgcttggtgtaatcaccttcgccggtacgaccgcggccaagatcattggtctttacgaactcgatatgttttttctgacaggggatgcgctcattgtcgctttgccggcgatcgccggcaacattggaggcagttactggagcggcgcaacccaatctgccagcagcttgtaccgtcgcttcgctcaggttgagcgaggctaggtcgcgcaaaaattcgcctcaatggagaattctatgaagtattgcctgctgtgcctagttgtcgctttgagcggctgccagacaaacgacacattagcgagctgcaaaggcccgatcttcccgctgaatgtggggcgatggcagcctactccgtcagatcttcagctcggcaattcgggtggacgctatgacggggcctgaatatgccatgctagtggcgcgcgaaagccttgccgagcactataaggaagtagaagcctttcaaaccgcgcgagcgaaatcggcgcgacgtctctccaaactcattgcagctgtcgcagctatcgcgattttgggaaatgttgctcaagcgttcgctatagccacaatggtgccgttgagcaggcttgtgcccgtatatctatggatacggccggacggcaccgttgacagcgaggtgtctgtctcgcgattgcctgcaactcaagaggaggccgtcgttaacgcctcattgtgggagtacgttcgcctgcgcgagagttatgatgccgacaccgctcagtacgcctacgacctggtatcgaacttcagtgccccaacagtgcgccaggattaccagcaattcttcaactatcccaatcccagttcgcctcaagtcattcttggcaaacgcggcagggtggaggtcgagcacatcgcttcaaatgatgtaactccaagcacgcagcaaattcgctataaaaggaccctcgtcgttgacggcaaaatgcctgtggtgagtacgtggaccgcgacagttcgctacgaaaaggtgaccagcttgcccggcagattgagactaaccaacccggcaggtctggttgtcacctcctatcagacatcggaagataccgtttcaaacgtaggccacagcgaaccatgatcagaaaagcacttttcattttagcatgtttatttgccgctgcgactggtgcggaggctgaagacactccaatggcgggcaagctagatccgcgcatgcgttatttggcttacaatcccgatcaagtggtgcgcctctcgacggcggttggagctactttggtcgtaacattcgccacgaacgaaacggtgacagcggttgccgtttcaaatagcaaagatctagcagccctaccgcggggaaattatctatttttcaaggcaagccaggtcctcacgcctcagccagtaatcgtgctaaccgcaagcgactccgggatgcgccgttatgttttcagtataagttccaagactctgtcccacctcgataaagagcagcccgatctctattacagcgtccaattcgcctaccccgccgacgatgcggcggctcggcgaagggaggcacaacagaaggctgttgtggacagactacacgcggaagcacaatatcaacggaaagctgagaatttattggatcagcctgtcacagcccttggtgcggcggacagtaattggcactacgtcgcccaaggcgatcgttcgctgttgccactcgaagtcttcgacaatggatttacgacggtattccactttccgggcaatgtacgcataccctccatctacaccatcaatcctgatggcaaggaagctgttgccaactattcagttaaagggagcgatgtcgagatttcttcggtttcccgaggttggcgtctgagggatggccacacagtactatgtatctggaacaccgcttacgatcccgttggccaaaggccgcaaacgggcacggtgaggcccgatgtgaaacgcgtcctgaagggggcgaagggatgaataacgatagtcagcaagcggcacatgaggttgatgcatctggatccctggtctccgacaaacatcgccggcgtctttcggggtctcagaaattgatcgtcggaggtgtcgttctcgcgttatcattaagcctcatttggctaggtgggcgccaaaagaaggtgaatgagaacgcatcgccgtcaactttgatcgcaacaaacaccaagccatttcatccagctccgattgaggtgccgccggatcctccagcggttcaagaggctgttcagcctgctgctcctctaccgccgaggggcgaaccggagcggcatgagccacggccggaagaaacaccgatttttgcatatagcagcggcgatcaaggggtcagcaaacgcgccattcagggcgacacgggccgaagacaagaaggcaagcgtgacgacaactccttgccgaatggcgaagtgtccggcgagaacgatttgtcgatacgtatgaaacccaccgagctgcagcccagcagcgccacgctcttgccgcaccccgattttatggtaacgcaagggacaataattccgtgcatcttgcaaaccgcaatcgacacaaatttggcaggctatgtaaagtgtgtcttgcctcaggatattcgtggaacaacgaacaatatcgtgcttcttgatcgtggcaccaccgttgttggcgaaatacagcgtggcttgcaacagggagatgggcgcgtttttgtgttgtgggatcgcgccgagacacctgaccatgcgatgatctcgttaacatcgccaagcgcggacgaactcggtcgctcaggattgccgggctcggtcgacagccacttctggcagcgttttagcggagctatgctcttgagtgttgttcaaggcgccttccaggcagctagcacctacgccggcagctcgggtggcgggatgagcttcaacagctttcaaaataacggtgagcagacaactgagacagcccttaaggcaaccatcaacataccgccaaccctgaagaagaatcagggtgacaccgtttccattttcgtagcacgggacctcgatttctttggtgtttaccagctccgcctgactggcggcgccacgcgggggaggaaccgccgctcttaatgaattcaaatttccgcttagagataggatacattgtaaatggaagtggatccgcaactacgctttcttctgaagccgattttggaatggctcgatgacccgaagactgaagaaattgcgatcaatcgacctggagaggcatttgtgcgccaagccggcatttttaccaagatgcctttgcccgtctcttatgatgatcttgaagatatcgctattttagcgggcgcgctgagaaagcaggatgtcggaccacgtaaccccctctgcgccactgaacttcctggtggtgaacgactacaaatctgtctgccgccgaccgttccctcgggcaccgtcagcttgaccattcgacggccaagctcgcgtgtttctggtcttaaagaagtctcctcccgttatgatgcttcgaggtggaaccagtggcagacacgaaggaaacgccaaaatcaggatgatgaagctatccttcagcattttgacaacggggatttggaagcgtttctgcacgcatgcgtcgtcagccgactgacgatgttgctatgtggccctaccggaagcggcaagacaacaatgagcaagaccttgatcagcgccatccccccccaggaaaggctaatcaccatagaagatacgctcgaactcgtcattccacacgataatcatgttagactactctactccaagaacggtgctgggctgggtgctgtgagcgccgagcacttgctccaagcaagtctgcgtatgcggccggaccggatattgcttggcgagatgcgcgacgatgcagcatgggcttatctgagtgaagtcgtctcgggacatccgggatcgatttcaacaatacacggcgcgaatccaatccaaggattcaagaaactgttttcccttgtcaaaagtagcgcccaaggtgctagcttggaagatcgcacactgattgacatgctctctacggcgatcgatgtcatcattccattccgtgcctatgaggacgtttatgaagtaggcgagatctggctcgcggcggacgcacgacgccggggcgagaccataggcgatctccttaatcaatagtagctgtaacctcgaagcgtttcacttgtaacaacgattgagaacttttgtcataaaattgaaatacttggttcgcattttcgtcatccgcggtcagccgcaattctgacgaactgcccatttagctggagatgattgtacatccttcacgtgaaaatttctcaagcgctgtgaacaagggttcagattttagattgagaggtgagccgttgaaacacgttcttcttatcgatgacgatgtcgctatgcggcatcttattatcgaataccttacgatccacgccttcaaagtgaccgcggtagccgacagcacccagttcactagagtactctcttccgcgacggtcgatgtcgtggttgttgatctaaatttaggtcgtgaagatgggcttgagatcgttcgaaatctggcggcaaagtctgatattccaatcataattatcagtggcgaccgccttgaggagacggataaagttgttgcactcgagctaggagcaagtgattttatcgctaagccgtttagtacgagagagtttcttgcacgcattcgggttgccttgcgcgtgcgccccaacgttgtccgctccaaagaccgacggtctttttgttttactgactggacacttaatctcaggcaacgtcgcttgatgtccgaagctggcggtgaggtgaaacttacggcaggtgagttcaatcttctcctcgcgtttttagagaaaccccgcgacgttctatcgcgcgagcaacttctcattgccagtcgagtacgcgacgaggaggtttacgacaggagtatagatgttctcattttgcggctgcgccgcaaacttgaggcggatccgtcaagccctcaactgataaaaacagcaagaggtgccggttatttctttgacgcggacgtgcaggtttcgcacggggggacgatggcagcctgagccaattgcatttgattaatttaggtgactgaggacgcggccagcggcctcaaacctacactcaatatttggtgaggggttccgataggtccctcttcaccaattgctcgatggcttctctccagcaaagaatgacgcgagcgcggcggtagccagcttgtggccgaaagctcgagcggtctccaaccccaacggatcaaaatgacttcgagcgacctcgagcaacgcaaccgggaacatgcgtgaggtctgaacgagaacggatttttctgtagttgaagggatcggataacttttcggggccacgcgaaatgatccatctgccagcatgctttcgaaatcgtccaacgcgcgccttaaaatcatttgtagcgacttcgagggactgtattgccgaacgaggttgtcatatgttttcgacacttgaggcgcgggcggtcgcgctgaaagaaaaacctggagctttttcggggacggaggtggactaagggcatccacagttagcttaagttgtcgatcgggactgtaaatgtgatcggcgacgagaggctcacgttgctggtctttctcgtcggctttttcaggcaagtgctggaggtccagcttctggggaacaagtgtcgggttgggatggtggatctcgggtcgagcaccagcaagccgccgtgcttcgccgaccgacaatgcgggcttgcgaattgccatcttcaagcctccaagattttgctgatcagtttcgaaatgaccacgacttcctccatcgcaatccgaagattcctctctatgaggcgcatcgtcggatcagttcccgtgtttagtaatgtaagatgcaacatgccgcgttctttcatcgcggcaaatgcatctctttcatgcatgggagacggtacaactggaaggctctctagcgtctctgacatcctgcgttgcgatgttgtcaatcggccgaccgggacgcgttggcgcaaaacagctgtaggaattgccaaattttcactcaacagcagctcgatgacgtagcggtaggtagatagtgcctcatcgatgtcgagcggcgttagcatggtggggatcagaagcaggtttgagctagcgatgattgtgttgttgagctcgctcgagccgccacgcgtatcggccaacgcataatcaaatccttcgagctcggcattttcataggctgcttcaagaaggggcatttcgtcggcggaatagacttcacagcgaggatcccaggtactgctttgtaaggcgttttctctccatcgcgtcagaggccggttttcgtcggcatcaaagagggccactcgtttaccgtcatttgccaaagcagcgcaaaggcccatgagtgcggtggttttgccagcaccccctttgaaagaacaaaacgtcaaaagttgcatattctgatcccgcctatcctgtgaaaccggagtgcatttgtatttttgttcgtataaatgtttttgtgattatcgatgagtaaaagcgttgttacactatttttatttcacattcgttataagacaattgcaaatgtagcaagtatattcagtattgactgtaaatgtactgttgatttcatattgagcagggctagacttccatccgtctacccgggcacatttcgtgctggagtatccagaccttccgctttctttggaggaagctatgtcaaaacacaccagagccacgtcgagtgagactaccatcaaccagcatcgatccctgaaagttgaagggttcaaggtcgtgagtgcccgtctgcgatcggccgagtatgaaaccttttcctatcaagcgcgcctgctgggactttcggatagtatggcaattcgcgttgcggtgcgccgcatcgggggctttctcgaaatagatgcagacacacgagaaaagatggaagccatacttcagtccatcggaatactctcaagcaatgtatccatgcttctatctgcctacgccgaagaccctcgatcggatctggaggctgtgcgagatgaacgtattgcttttggcgaggctttcgccgccctcgatggactactgcgctccattttgtccgtatcccggcgacggatcgacggtcgctcgttactgaaaggtgccttgtagcacttgaccacgcacctgacgggagaaaattggatgcccgatcgcgctcaagtaatcattcgcattgtgccaggaggtggaaccaagacccttcagcagataatcaatcagctggagtacctgtcccgaaagggaaagctggaactgcagcgttcagcccggcatctcgatattcccgttccgccggatcaaatccgtgagcttgcccaaagctgggttacggaggccgggatttatgacgaaagtcagtcagacgatgacaggcaacaagacttaacaacacacattattgtaagcttccccgcaggtaccgaccaaaccgcagcttatgaagcaagccgggaatgggcagccgagatgtttgggtcaggatacgggggtggccgctataactatctgacagcctaccacgtcgaccgcgatcatccacatttacatgtcgtggtcaatcgtcgggaacttctggggcaggggtggctgaaaatatccaggcgccatccccagctgaattatgacggcttacggaaaaagatggcagagatttcacttcgtcacggcatagtcctggatgcgacttcgcgagcagaaaggggaatagcagagcgaccaatcacatatgctgaatatcgacgccttgagcggatgcaggctcaaaagattcaattcgaagatacagattttgatgagacctcgcctgaggaagatcgtcgggacctcagtcaatcgttcgatccatttcgatcggacgcatctgccggcgaaccggaccgtgcaacccgacatgacaaacaaccgcttgaaccgcacgcccgtttccaggagcccgccggctccagcatcaaagccgacgcacggatccgcgtaccattggagagcgagcggggtgcccaaccatccgcgtccaaaatccctgtaactgggcatttcgggattgagacttcgtatgtcgctgaagccagcgtgcccaaacaaagcggcaattccgatacttctcgcccggtgactgacgttgccatgcacacagtcgagcgccagcagcgatcaaaacgacgtcatgacgaggaggcaggtccgagcggagcaaaccgtaaaagattgaaggccgcgcaagttgattccgaggcaaatgtcggtgagcccgacggtcgcgatgacagcaacaaggcggctgatccggtgtctgcttccatccgtaccgagcaaccggaagcttctccaacgtgtccgcgtgaccgtcacgatggagaattgggagaacgcaaacgtgcaagaggtaatcgtcgcgacgatgggcgcggggggacctagactagtagacaggaaggaccgaataatggcaaatggtcagttcacgatacgctctgctcgcccggcctccgtcggactgacaggcgaacggcgtggagccgcatccgcctctagctctgcactgtccaatgttcaaagagatgttagggataggctgattccaactagctcaccaagattaccaaatgcagccatattgcgtgattcctcgggaagagcgtcgactggtctgcggtacatggcggctactcttcattggtctgcgatcgcgccattatcgctaataaacagcaacgacctggctccggccgcttatgactttgagacgcgaaataacgcaagaaatgtgactgccaaagtcggcagggcagtccctgttcccaagcaaggcgggctcggcaaaacgctcgcacccgtaccccttagtacacgtatatcaagggtcaattccgaccgaagactgcccgctgacgcagaagaccgccctgaaacgcgcgacccccagaaaggacgtggcagtcatggtgcgacgccaaccttacatgaaaagattggaaccgcgtttgctcgaagattgcgaaagcatacgtactatattgtttgcagttgctgccagacccggagcgcgttgacgatgggtgcaaagatttcggtgaagtcatgaactccagcaagacttcgccccagcgtatgaccctgagcatcgtatgttcgctggcagccggtttttgtgcggccagctgctatgtaacgttccgccggggcttcaacggcgaagcgatgatgacgttcgacgttttcgctttttggtatgagaccccgctttacttgggttatgccagcaccgtcttctggcgtggtttatctgttgtcatctttacctcgctgatcgttctttcaagtcagctcatcatatcgctgcgcaatcagaagcatcatgggacagctcgttgggcagaaattggcgaaatgcggcatgctggttatctgcagcgttacagtcgcatcaaggggccgatctttggaaagacatgtggtcccctttggttcggcagttatttgaccaatggcgaacagccacacagtcttgtcgtcgcgccaacgcgtgctggcaaaggcgtcggcatcgtcattccaacgctgttgaccttcaagggctcggtaatcgcccttgacgtcaagggagaattgtttgaactgacgtccagagcacgcaaagcgagcggcgacgcagttttcaagttctcccccctagatcctgagcggaagactcattgttacaatccggtcctggatattgccgcacttccgcccgaacgccagttcactgaaacacgccgtctagctgcgaaccttattacggctaagggaaagggagcagaaggctttattgacggcgcacgtgacctgttcgtcgcgggaatccttacctgcattgagcgtggcacaccaacgattggcgcggtatatgacctatttgcgcagcctggcgaaaagtataagctttttgcgcaactcgcggaggaaagcctaaacaaagaggctcagcgtatcttcgataatatggcgggcaacgacacgaaaattctgacatcgtacacctctgtgctgggcgacggtggactgaacctgtgggctgatccgcttatcaaagcagcgacaagccggtcagacttttccgtttacgatctccggaggaagaagacctgcatttatctttgtgtcagtcccaacgatctggaggtcttggcaccacttatgcgcctgatgtttcagcagctcgtgtcaatcttgcagagatcgctgccaggtgaagacgagtgccatgaagttttatttctcctcgacgaattcaaacacctgggcaagcttgaggccatagagaccgcgatcacaaccatcgccggttacagaggccgctttatgtttattattcaaagtctttcggccttgtcgggcacatacgatgacgcaggaaaacaaaactttctgagcaatactggcgtacaagtatttatggccacggctgatgacgaaactccaacctacatctcaaaagctatcggcgaatatacgtttaaagcgcgttcgacctcttacagtcaagccagaatgttcgaccacaacatccagatttctgatcaaggtgcagcccttttgcgccccgaacaagtgcgcctgctagacgatcagagtgaaatcgttctcatcaaagggcgacctccactcaaattacgaaaggtgcagtattattccgatcgtacgctgaaaggccttttcgaacgccagatgggctctctgcctgagcccgcacccttgatgctttccgactatagcaacgatcaagttcaataccacttggctccgatagcaaattttaatgaggatgctgcaccgcaaaacagaactgtggccgaggaccatggaagtgttaaagtcggtgctgatatccctgaacgcgtgatgggaataaatggtgacgaggaacaagccgatgcgggcgagataccgccggaatcggttgtgcctccagaattgacgctcgctctgaccgctcaacagcaattgttggaccagattattgcacttcagcaaagatcgaggtccgcaccggcatagcctgcgaaatgatcttaatggtgcaattcgtttcaggcggcatgttgcggttcaacaaagtgtacgccagatcccaattggccctttacgaggtgtcggtatgacaggaaagtcgaaagttcacataagaggttcggctgacgcgcttcctgacgttcctggcggaagtactaccgccccttttttaaccgaaccttctcgggatcaggttgatgcctcgtttgaggtccaaaccgactacagccagtctacttccgtgtcgtttacctatgatggtgttggacttggtcctgccgagcgtgcggcttacgagaactggtgcgaaccgggccggcccacttggaaagatcttataatcaaggcacgtgtcgatccgattgacgatgtgacctggctccgagatttagaagaggacaccccctcaaccttcagatacgaagggatgcctctgggcatcggggaacgacaggcctacgaaaattggcaagaggacgctcagccgacatgggaagaccttgttgtcagcgcacgcttgacggaacttggccgtccacacgggattaccggcgagtatacatccctcgcaggatcgaagaatacaagttcaatttcattgaagcgaaagcggagcaacttaattgatgatgagaattcatccggatcgttttcatatgacgggatgaagctcggggaagccgagcgttctgcatatggtgactgggccgaggcggagccacccacgtggaaagatttggtattgagggcacgcgtttcctcgatcaatgactctgcttggctttttgattcacaaacatcttcatcatcatttgaatacaacggtgttcccttgggcgagccggaacggcaggctctcagacaatggcaaggagacgctcagcctacctgggaagatctcgttgttaacgcgcgtatggcagaactttgccatgctggttggattgaaggtcaaaaaggttgctttgaagagcgcggggaggctctgcccgcgtcggaacgcggttcgcaacgccccattggtcaacggacagattcctccgattcttttgtgtatgatggcacaaggctcggagcacctgagcgaactgcttatgaacgctggagtaagagggaacgcccgacttgggaagatctcatcttagatgcacaccaggccaggactgaaagtgacgctgttacgacccaagcgattggtcagtcgtcctcaccggttttcttatatgaaggaaagtcgctcggagacagggaacgaaaggcttacgaaaaatggcggcagccagcccaaccgcgatggcaaaatcttgtagtgaacgctcgtctggcagaaatcgatccctcagcctggattgccgatgagcgcgatccgcttgatgatagcgacgcgcttggtcgcccgtcgtacacaagcttgacggatagatcagacgtccctttagacgatcaatcaatctatcgtcgttccgacctagtaagggagcaggtgccagaatcgtctcaaaggcaattcgcagcatgttcagaatctgaaacgaggcctgtgcaatggtttactgcttctgggtcagatgcaaacaatacggaaaatatcaccgccagcgatcccgtcgatcgcacgggtggagttaagcggctaggctccaaaagcgacagaaccgttacagcttctatccatgacgtgaattccagcacaaggcgactgttgcttaacgaatttggatcggaggctccgcgcccttcgccagaaaagactgttcgcttaagaagcgacaatattggcacctatgggagccggaaaaatgaacgagcgcggctcgcgaccgaaaccggtgcgtatgagtcggagcatattttcgggttcaaggctgtccacgatactgcgagagcgacgaaagagggccggcgtctcgaaaggcccatgcccgcctaccttgaggataaggggcttcatcgccaacatattggcaccgggagaggacggaccaaacttgtcgggcgcggatggccggatgacacaagctatcgctcggatcaaagggcaactctgtcggaccccgttgcgcgctcggaaggcgcgacggcctcaaatgggtatcaattgaaccaattgggttacgcgcaccaactcgctagcgatggcctgcaaagtgaatcgcccgatggtgttgccttgccaattcaagtggcaacaacgagctacaactatacagtgagccgcgatcctgtccttgttccgccggataaaaacgaagcccctcaattgctgcatcttggtccccgtggtcaaaccgaagctgttcttgcccgcgaaacagcattgactggaaaatggccgactctcgagcgtgagcagcaagtgtatcgcgagtttttggccttatatgacgtaaaaaaagatcttgaggccaaatcagtcggcgtaagacggaaaaaaaaagaagttatttctgcgttagaccgaactgcgcgcttgataagcacgtcgccttcgaaagctcgatccaaagcagagactgaaaaagccattgatgagctcgatgatcgacgagtttatgatccgcgtgatcgagctcaagacaaagcgtttaaacgctgataagtcgccaatatagtgatcatttgcagtattcgcatcgatcgctggttgatattctgccgctggtcgaccggctgctcgtcgccaaaaatgctcacagggatacgatggcctcggtcaggccgcgtgcgtcctgtctttccagttcctccctttcagctcgattgtggcatcatttattgcctgctcattgcagttgaaacgcgatatccgtttcaagacccgggtatggatggtactttggagatatgagcacttgccagacttcccggtcggagacttaaaaattccgataagaggttacggacgacggaccttataagtggatcgtctagtggtggcgccgatcaaaacagttccgcccccggctttgctcaaagtagcaaagcagctttatctcgggttgcggaggattttctagaaaaccgcaattttgcaggagagaacatatggccatcatcaagccgcatgtgaacaaaaataggacaacctcgccgatagagagaccggagtctctcatagaggaaatgagcggcagtcatccgccgagtggttttaccaacctggatctcgctatgatcgagctggaggactttgtccatcggtgcccgctcccagaagacaatcttgctggtcagaaggagtgagacgatggatccgtctagcaatgagaatgtctatgtgggtcgcggtcacaacatcgaaaatgatgatgacactgaccccaggcgttggaagaaggcgaatatcagttccaacaccatctccgatattcagatgacgaatggcgaagacgtacaatcagggagccctacccgaacggaagttgtaagcccacgtctggattatggatcggtcgactcctcctccagcctttattctggcagcgagcacggaaatcaagctgagattcaaaaagagctgtccgtcttgttctcgaacatgtctttgccaggcaacgatcggcgcccggacgaatacattctcgtgcatcaaacgggacaagatgcttttactggtattgccaaaggcaacctcgaccaaatgcccaccaaggcggaatttaacgcgtgctgccgtctctacagggacggagccggtaattactacccgccacctctcgcattcgacaagattagcgttccagagcaactggaggaaaaatgggggatgatggaggcgaaggaacgtaacaaactgcggtttcagtacaagttggacgtatggaatcatgcgcacgctgatatggggatcacgggcacagagatcttttatcaaacagataagaacataaagctcgaccggaattataaactaagacctgaagaccgatacgtacaaacagaaaaatacgggcgccgggaaattcaaaagcgatatcaacacgaactccaggctggttcgctgctgcccgatattatgatcaaaactccccaaaatgacatccacttcgtgtacaggtttgccggcgacaattacgccaacaaacagttcagcgagtttgaacacaccgtcaagcgcaggtatggcgacgagactgagatcaaattgaagtcaaagtcaggcattatgcatgactcgaaatatctggaatcctgggaacggggcagtgcggatattcgcttcgcggaattcgttggggaaaatagagctcacaatcggcagtttccaactgcgacagtaaatatgggacagcagccagacgggcagggcggtttgacccgcgaccgtcatgtgagcgttgacttcctaatgcaaagcgcacccaattcgccttgggcgcaagctttgaaaaagggagaactgtgggatcgcgttcagttgcttgctcgcgacggcaaccgctatctgtcgccgcccagattggaatattctgaccctgcacatttcaccgagttgatgaaccgggttggtttacccgcatcgatgggtcggcaaagccatgcggctagtatcaaattcgaaaagtttgacgcgcaggcagcggttattgtcttaaatggcccagagttacgtgacattcatgacttgtctcctgaaaaactgcaaaatttgtccaccaaagatgtcatcgtcgccgatcgcaatgagaatggtcagagaactggcacgtacaccagcgtcgcggaatatgagcgcttgcagttaaggctgccacccgatgcagcgggggtgcttggtgaagcaactgacaaatattcacgtgatttcgttcggccagagccggcgtcgcgtccaatcagtgacagccgcaggatatacgaaagtcgaccgcgtagccaaagcgtcaacagcttttgacgttcctgctgccgcgtcaacgaggaagctcgtttgacccgggtttgccaatgaaagggctcaatcatggtgaacactacaaagaaaagttttgcgaagtcgcttacggcagatatgcgccgttctgctcagcgcgttgtcgagcaaatgcgaaaagcattgattaccgaagaagaggcgctcaagcggcaagccagactggagagtcccgataggaagcgaaagtatgctgctgatatggcgatagtcgacaaactcgacgtagggtttcgaggcgaaataggctataaaattcttggaaataaccggcttcgagtagacaaccataaagaattaacgcgtgagcacggtagacttcgcaaaaccaaaacggttctgaagcgtaacccggtgacgcaggaagtctatttgggtttatatgaaaggaagtcctggttaagtgtcagcagccatttgtatgctgcggacggcacactccgcatgaagcacgtgaaatacaaagacggacgttttgaggaaaaatgggagcgcgacgaaaatggcgacctgatccgcacaaggtacgccaaccgtggcaggctctttcaacctgtatccgagaaaatgggcgcgccgtatcggagcggccctgacgaccggctctatcgcgatctaacccgtcgaaacggtttcagacgggagacattcgaacgggacgatcacggaaacctcgagcgtatcggcagcaaccatgtcggcttttccaagatttcagtgaaggcacccaatcgtcaaacctcccagacgaagattcaaaaacttggtggcgctttcaacaaatcttttaggtcccttctggacaaggagggcaatgaaatgggccgcgatattttgagccatcgacggctctataacaagcggtctgctgtctacgatgaagctaccggacaattgaagagtgccaagcataccttcggcaagatctacaggagcgaaaccgaatatctcagcgcgggcctcaagaaggtttcaaaaaagatactcggggtgacggtctaccggaaatttgcggcgctcagcgagcgagaatccgaggctgagagactgcgtagttttgaatccggtgcgcatcgccagatctggcaggagcgggcagcgattcccggttcgcccctcccggagactgatgacattcatttcgcacagcagtcgcacctagccaaagccaaccctgatcacgtcgaagctgacgtcacgcgtgtgacagatcaacatgttgatgttgctggacaaacatcatcgtctccccaacggaacttggaaggatggttagattctcaatcacgatacaagccagcaaacatgctgttgtcaaatccagaccttcaagcgaacggacctcgcccatacgaagggttagctcatctcaccctccggcgcgataatgaatctgacgggcacaaggagaatgatcagcggctgcgacatttctcccagccagagccgttggtgttaccgcatcccgggtcgccggaaataactaaggtgtttggctcgcggggagagccggcacacccgagtggaaatctgcacacggcggttggagaaacggcttgcgaaggaccggtgatgtcttcatcctcggacaatcatcagccagctccaggacagcaagaacttttaagtttccttcataatgcgccagccccagtttctgtggcaatacatgatgatcaagagcgacttgcgggggaggcgcccggcggctctttcagaggtagctcagggcgaacgagttcaatgtcggagagtatcttcgacgaagatgtacaagggcatttggtacgggattattcgatcaatactactaacgggtttattgacccgcaatcgttgttcggtgaaccggacttatcgagaggtccaaaatcggggccagaaattccatcggaagattaccatttgtcagcttcggaacaggaaaatttgctgaatcaattgcttagtgtgccactgccggttccttcaccgaagcccgaatgcgcgaggtctatgattttcgaaggttcacgttcaagagagcgttccacctccagagggttctaaggtggaacgcgtctaggcttgcctatcatcaccacctcatgatggtcgcggagaccttcgaagagatatccgacatcattggagaagctgggccggaaactagtgtacctcgcgaatgcatctagatccaatccaatatgcatggcatgccgaatccatgtgggagtttattcttgacacagatatttatgatataataactgagtaagcttaacataaggaggaaaaacatatgttacgcagcagcaacgatgttacgcagcagggcagtcgccctaaaacaaagttaggtggctcaagtatgggcatcattcgcacatgtaggctcggccctgaccaagtcaaatccatgcgggctgctcttgatcttttcggtcgtgagttcggagacgtagccacctactcccaacatcagccggactccgattacctcgggaacttgctccgtagtaagacattcatcgcgcttgctgccttcgaccaagaagcggttgttggcgctctcgcggcttacgttctgcccaagtttgagcagccgcgtagtgagatctatatctatgatctcgcagtctccggcgagcaccggaggcagggcattgccaccgcgctcatcaatctcctcaagcatgaggccaacgcgcttggtgcttatgtgatctacgtgcaagcagattacggtgacgatcccgcagtggctctctatacaaagttgggcatacgggaagaagtgatgcactttgatatcgacccaagtaccgccacctaataatgtctaacaattcgttcaagccgacgccgcttcgcggcgcggcttaactcaagcgttagatgcactatacgtaccaatccaaatcggatccccctgcagggctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacc

SEQ ID NO: 37 - DNA, 3671 bp, Escherichia coli
tcagcctgccgccttgggccgggtgatgtcgtacttgcccgccgcgaactcggttaccgtccagcccagcgcgaccagctccggcaacgcctcgcgcacccgctggcggcgcttgcgcatggtcgaaccactggcctctgacggccagacatagccgcacaaggtatctatggaagccttgccggttttgccggggtcgatccagccacacagccgctggtgcagcaggcgggcggtttcgctgtccagcgcccgcacctcgtccatgctgatgcgcacatgctggccgccacccatgacggcctgcgcgatcaaggggttcagggccacgtacaggcgcccgtccgcctcgtcgctggcgtactccgacagcagccgaaacccctgccgcttgcggccattctgggcgatgatggataccttccaaaggcgctcgatgcagtcctgtatgtgcttgagcgccccaccactatcgacctctgccccgatttcctttgccagcgcccgatagctacctttgaccaccatggcatcagcggtgacggcctcccacttgggttccaggaacagccggagctgccgtccgccttcggtcttgggttccgggccaagcactaggccattaggcccagccatggccaccagcccttgcaggatgcgcagatcatcagcgcccagcggctccgggccgctgaactcgatccgcttgccgtcgccgtagtcatacgtcacgtccagcttgctgcgcttgcgctcgccccgcttgagggcacggaacaggccgggggccagacagtgcgccgggtcgtgccggacgtggctgaggctgtgcttgttcttaggcttcaccacggggcacccccttgctcttgcgctgcctctccagcacggcgggcttgagcaccccgccgtcatgccgcctgaaccaccgatcagcgaacggtgcgccatagttggccttgctcacaccgaagcggacgaagaaccggcgctggtcgtcgtccacaccccattcctcggcctcggcgctggtcatgctcgacaggtaggactgccagcggatgttatcgaccagtaccgagctgccccggctggcctgctgctggtcgcctgcgcccatcatggccgcgcccttgctggcatggtgcaggaacacgatagagcacccggtatcggcggcgatggcctccatgcgaccgatgacctgggccatggggccgctggcgttttcttcctcgatgtggaaccggcgcagcgtgtccagcaccatcaggcggcggccctcggcggcgcgcttgaggccgtcgaaccactccggggccatgatgttgggcaggctgccgatcagcggctggatcagcaggccgtcagccacggcttgccgttcctcggcgctgaggtgcgccccaagggcgtgcaggcggtgatgaatggcggtgggcgggtcttcggcgggcaggtagatcaccgggccggtgggcagttcgcccacctccagcagatccggcccgcctgcaatctgtgcggccagttgcagggccagcatggatttaccggcaccaccgggcgacaccagcgccccgaccgtaccggccaccatgttgggcaaaacgtagtccagcggtggcggcgctgctgcgaacgcctccagaatattgataggcttatgggtagccattgattgcctcctttgcaggcagttggtggttaggcgctggcggggtcactacccccgccctgcgccgctctgagttcttccaggcactcgcgcagcgcctcgtattcgtcgtcggtcagccagaacttgcgctgacgcatccctttggccttcatgcgctcggcatatcgcgcttggcgtacagcgtcagggctggccagcaggtcgccggtctgcttgtccttttggtctttcatatcagtcaccgagaaacttgccggggccgaaaggcttgtcttcgcggaacaaggacaaggtgcagccgtcaaggttaaggctggccatatcagcgactgaaaagcggccagcctcggccttgtttgacgtataaccaaagccaccgggcaaccaatagcccttgtcacttttgatcaggtagaccgaccctgaagcgcttttttcgtattccataaaacccccttctgtgcgtgagtactcatagtataacaggcgtgagtaccaacgcaagcactacatgctgaaatctggcccgcccctgtccatgcctcgctggcggggtgccggtgcccgtgccagctcggcccgcgcaagctggacgctgggcagacccatgaccttgctgacggtgcgctcgatgtaatccgcttcgtggccgggcttgcgctctgccagcgctgggctggcctcggccatggccttgccgatttcctcggcactgcggccccggctggccagcttctgcgcggcgataaagtcgcacttgctgaggtcatcaccgaagcgcttgaccagcccggccatctcgctgcggtactcgtccagcgccgtgcgccggtggcggctaagctgccgctcgggcagttcgaggctggccagcctgcgggccttctcctgctgccgctgggcctgctcgatctgctggccagcctgctgcaccagcgccgggccagcggtggcggtcttgcccttggattcacgcagcagcacccacggctgataaccggcgcgggtggtgtgcttgtccttgcggttggtgaagcccgccaagcggccatagtggcggctgtcggcgctggccgggtcggcgtcgtactcgctggccagcgtccgggcaatctgcccccgaagttcaccgcctgcggcgtcggccaccttgacccatgcctgatagttcttcgggctggtttccactaccagggcaggctcccggccctcggctttcatgtcatccaggtcaaactcgctgaggtcgtccaccagcaccagaccatgccgctcctgctcggcgggcctgatatacacgtcattgccctgggcattcatccgcttgagccatggcgtgttctggagcacttcggcggctgaccattcccggttcatcatctggccggtggtggcgtccctgacgccgatatcgaagcgctcacagcccatggccttgagctgtcggcctatggcctgcaaagtcctgtcgttcttcatcgggccaccaagcgattcccacacattatacgagccggaagcataaagtgtagctagatccgaaggatgagccgggctgaatgatcgaccgagacaggccctgcggggctgcacacgcgcccccacccttcgggtagggggaaaggccgctaaagcggctaaaagcgctccagcgtatttctgcggggtttggtgtggggtttagcgggctttgcccgcctttccccctgccgcgcagcggtggggcggtgtgtagcctagcgcagcgaatagaccagctatccggcctctggccgggcatattgggcaagggcagcagcgccccacaagggcgctgataaccgcgcctagtggattattcttagataatcatggatggatttttccaacaccccgccagcccccgcccctgctgggtttgcaggtttgggggcgtgacagttattgcaggggttcgtgacagttattgcaggggggcgtgacagttattgcaggggttcgtgacagttag

SEQ ID NO: 38 - DNA, 15028 bp, Escherichia coli
ctagcgtttgcaatgcaccaggtcatcattgacccaggcgtgttccaccaggccgctgcctcgcaactcttcgcaggcttcgccgacctgctcgcgccacttcttcacgcgggtggaatccgatccgcacatgaggcggaaggtttccagcttgagcgggtacggctcccggtgcgagctgaaatagtcgaacatccgtcgggccgtcggcgacagcttgcggtacttctcccatatgaatttcgtgtagtggtcgccagcaaacagcacgacgatttcctcgtcgatcaggacctggcaacgggacgttttcttgccacggtccaggacgcggaagcggtgcagcagcgacaccgattccaggtgcccaacgcggtcggacgtgaagcccatcgccgtcgcctgtaggcgcgacaggcattcctcggccttcgtgtaataccggccattgatcgaccagcccaggtcctggcaaagctcgtagaacgtgaaggtgatcggctcgccgataggggtgcgcttcgcgtactccaacacctgctgccacaccagttcgtcatcgtcggcccgcagctcgacgccggtgtaggtgatcttcacgtccttgttgacgtggaaaatgaccttgttttgcagcgcctcgcgcgggattttcttgttgcgcgtggtgaacagggcagagcgggccgtgtcgtttggcatcgctcgcatcgtgtccggccacggcgcaatatcgaacaaggaaagctgcatttccttgatctgctgcttcgtgtgtttcagcaacgcggcctgcttggcctcgctgacctgttttgccaggtcctcgccggcggtttttcgcttcttggtcgtcatagttcctcgcgtgtcgatggtcatcgacttcgccaaacctgccgcctcctgttcgagacgacgcgaacgctccacggcggccgatggcgcgggcagggcagggggagccagttgcacgctgtcgcgctcgatcttggccgtagcttgctggaccatcgagccgacggactggaaggtttcgcggggcgcacgcatgacggtgcggcttgcgatggtttcggcatcctcggcggaaaaccccgcgtcgatcagttcttgcctgtatgccttccggtcaaacgtccgattcattcaccctccttgcgggattgccccgactcacgccggggcaatgtgcccttattcctgatttgacccgcctggtgccttggtgtccagataatccaccttatcggcaatgaagtcggtcccgtagaccgtctggccgtccttctcgtacttggtattccgaatcttgccctgcacgaataccagcgaccccttgcccaaatacttgccgtgggcctcggcctgagagccaaaacacttgatgcggaagaagtcggtgcgctcctgcttgtcgccggcatcgttgcgccactcttcattaaccgctatatcgaaaattgcttgcggcttgttagaattgccatgacgtacctcggtgtcacgggtaagattaccgataaactggaactgattatggctcatatcgaaagtctccttgagaaaggagactctagtttagctaaacattggttccgctgtcaagaactttagcggctaaaattttgcgggccgcgaccaaaggtgcgaggggcggcttccgctgtgtacaaccagatatttttcaccaacatccttcgtctgctcgatgagcggggcatgacgaaacatgagctgtcggagagggcaggggtttcaatttcgtttttatcagacttaaccaacggtaaggccaacccctcgttgaaggtgatggaggccattgccgacgccctggaaactcccctacctcttctcctggagtccaccgaccttgaccgcgaggcactcgcggagattgcgggtcatcctttcaagagcagcgtgccgcccggatacgaacgcatcagtgtggttttgccgtcacataaggcgtttatcgtaaagaaatggggcgacgacacccgaaaaaagctgcgtggaaggctctgacgccaagggttagggcttgcacttccttctttagccgctaaaacggccccttctctgcgggccgtcggctcgcgcatcatatcgacatcctcaacggaagccgtgccgcgaatggcatcgggcgggtgcgctttgacagttgttttctatcagaacccctacgtcgtgcggttcgattagctgtttgtcttgcaggctaaacactttcggtatatcgtttgcctgtgcgataatgttgctaatgatttgttgcgtaggggttactgaaaagtgagcgggaaagaagagtttcagaccatcaaggagcgggccaagcgcaagctggaacgcgacatgggtgcggacctgttggccgcgctcaacgacccgaaaaccgttgaagtcatgctcaacgcggacggcaaggtgtggcacgaacgccttggcgagccgatgcggtacatctgcgacatgcggcccagccagtcgcaggcgattatagaaacggtggccggattccacggcaaagaggtcacgcggcattcgcccatcctggaaggcgagttccccttggatggcagccgctttgccggccaattgccgccggtcgtggccgcgccaacctttgcgatccgcaagcgcgcggtcgccatcttcacgctggaacagtacgtcgaggcgggcatcatgacccgcgagcaatacgaggtcattaaaagcgccgtcgcggcgcatcgaaacatcctcgtcattggcggtactggctcgggcaagaccacgctcgtcaacgcgatcatcaatgaaatggtcgccttcaacccgtctgagcgcgtcgtcatcatcgaggacaccggcgaaatccagtgcgccgcagagaacgccgtccaataccacaccagcatcgacgtctcgatgacgctgctgctcaagacaacgctgcgtatgcgccccgaccgcatcctggtcggtgaggtacgtggccccgaagcccttgatctgttgatggcctggaacaccgggcatgaaggaggtgccgccaccctgcacgcaaacaaccccaaagcgggcctgagccggctcgccatgcttatcagcatgcacccggattcaccgaaacccattgagccgctgattggcgaggcggttcatgtggtcgtccatatcgccaggacccctagcggccgtcgagtgcaagaaattctcgaagttcttggttacgagaacggccagtacatcaccaaaaccctgtaaggagtatttccaatgacaacggctgttccgttccgtctgaccatgaatcgcggcattttgttctaccttgccgtgttcttcgttctcgctctcgcgttatccgcgcatccggcgatggcctcggaaggcaccggcggcagcttgccatatgagagctggctgacgaacctgcgcaactccgtaaccggcccggtggccttcgcgctgtccatcatcggcatcgtcgtcgccggcggcgtgctgatcttcggcggcgaactcaacgccttcttccgaaccctgatcttcctggttctggtgatggcgctgctggtcggcgcgcagaacgtgatgagcaccttcttcggtcgtggtgccgaaatcgcggccctcggcaacggggcgctgcaccaggtgcaagtcgcggcggcggatgccgtgcgtgcggtagcggctggacggctcgcctaatcatggctctgcgcacgatccccatccgtcgcgcaggcaaccgagaaaacctgttcatgggtggtgatcgtgaactggtgatgttctcgggcctgatggcgtttgcgctgattttcagcgcccaagagctgcgggccaccgtggtcggtctgatcctgtggttcggggcgctctatgcgttccgaatcatggcgaaggccgatccgaagatgcggttcgtgtacctgcgtcaccgccggtacaagccgtattacccggcccgctcgaccccgttccgcgagaacaccaatagccaagggaagcaataccgatgatccaagcaattgcgattgcaatcgcgggcctcggcgcgcttctgttgttcatcctctttgcccgcatccgcgcggtcgatgccgaactgaaactgaaaaagcatcgttccaaggacgccggcctggccgatctgctcaactacgccgctgtcgtcgatgacggcgtaatcgtgggcaagaacggcagctttatggctgcctggctgtacaagggcgatgacaacgcaagcagcaccgaccagcagcgcgaagtagtgtccgcccgcatcaaccaggccctcgcgggcctgggaagtgggtggatgatccatgtggacgccgtgcggcgtcctgctccgaactacgcggagcggggcctgtcggcgttccctgaccgtctgacggcagcgattgaagaagagcgctcggtcttgccttgctcgtcggtgatgtacttcaccagctccgcgaagtcgctcttcttgatggagcgcatggggacgtgcttggcaatcacgcgcaccccccggccgttttagcggctaaaaaagtcatggctctgccctcgggcggaccacgcccatcatgaccttgccaagctcgtcctgcttctcttcgatcttcgccagcagggcgaggatcgtggcatcaccgaaccgcgccgtgcgcgggtcgtcggtgagccagagtttcagcaggccgcccaggcggcccaggtcgccattgatgcgggccagctcgcggacgtgctcatagtccacgacgcccgtgattttgtagccctggccgacggccagcaggtaggccgacaggctcatgccggccgccgccgccttttcctcaatcgctcttcgttcgtctggaaggcagtacaccttgataggtgggctgcccttcctggttggcttggtttcatcagccatccgcttgccctcatctgttacgccggcggtagccggccagcctcgcagagcaggattcccgttgagcaccgccaggtgcgaataagggacagtgaagaaggaacacccgctcgcgggtgggcctacttcacctatcctgcccggctgacgccgttggatacaccaaggaaagtctacacgaaccctttggcaaaatcctgtatatcgtgcgaaaaaggatggatataccgaaaaaatcgctataatgaccccgaagcagggttatgcagcggaaaagcgctgcttccctgctgttttgtggaatatctaccgactggaaacaggcaaatgcaggaaattactgaactgaggggacaggcgagagacgatgccaaagagctacaccgacgagctggccgagtgggttgaatcccgcgcggccaagaagcgccggcgtgatgaggctgcggttgcgttcctggcggtgagggcggatgtcgaggcggcgttagcgtccggctatgcgctcgtcaccatttgggagcacatgcgggaaacggggaaggtcaagttctcctacgagacgttccgctcgcacgccaggcggcacatcaaggccaagcccgccgatgtgcccgcaccgcaggccaaggctgcggaacccgcgccggcacccaagacgccggagccacggcggccgaagcaggggggcaaggctgaaaagccggcccccgctgcggccccgaccggcttcaccttcaacccaacaccggacaaaaaggatctactgtaatggcgaaaattcacatggttttgcagggcaagggcggggtcggcaagtcggccatcgccgcgatcattgcgcagtacaagatggacaaggggcagacacccttgtgcatcgacaccgacccggtgaacgcgacgttcgagggctacaaggccctgaacgtccgccggctgaacatcatggccggcgacgaaattaactcgcgcaacttcgacaccctggtcgagctgattgcgccgaccaaggatgacgtggtgatcgacaacggtgccagctcgttcgtgcctctgtcgcattacctcatcagcaaccaggtgccggctctgctgcaagaaatggggcatgagctggtcatccataccgtcgtcaccggcggccaggctctcctggacacggtgagcggcttcgcccagctcgccagccagttcccggccgaagcgcttttcgtggtctggctgaacccgtattgggggcctatcgagcatgagggcaagagctttgagcagatgaaggcgtacacggccaacaaggcccgcgtgtcgtccatcatccagattccggccctcaaggaagaaacctacggccgcgatttcagcgacatgctgcaagagcggctgacgttcgaccaggcgctggccgatgaatcgctcacgatcatgacgcggcaacgcctcaagatcgtgcggcgcggcctgtttgaacagctcgacgcggcggccgtgctatgagcgaccagattgaagagctgatccgggagattgcggccaagcacggcatcgccgtcggccgcgacgacccggtgctgatcctgcataccatcaacgcccggctcatggccgacagtgcggccaagcaagaggaaatccttgccgcgttcaaggaagagctggaagggatcgcccatcgttggggcgaggacgccaaggccaaagcggagcggatgctgaacgcggccctggcggccagcaaggacgcaatggcgaaggtaatgaaggacagcgccgcgcaggcggccgaagcgatccgcagggaaatcgacgacggccttggccgccagctcgcggccaaggtcgcggacgcgcggcgcgtggcgatgatgaacatgatcgccggcggcatggtgttgttcgcggccgccctggtggtgtgggcctcgttatgaatcgcagaggcgcagatgaaaaagcccggcgttgccgggctttgtttttgcgttagctgggcttgtttgacaggcccaagctctgactgcgcccgcgctcgcgctcctgggcctgtttcttctcctgctcctgcttgcgcatcagggcctggtgccgtcgggctgcttcacgcatcgaatcccagtcgccggccagctcgggatgctccgcgcgcatcttgcgcgtcgccagttcctcgatcttgggcgcgtgaatgcccatgccttccttgatttcgcgcaccatgtccagccgcgtgtgcagggtctgcaagcgggcttgctgttgggcctgctgctgctgccaggcggcctttgtacgcggcagggacagcaagccgggggcattggactgtagctgctgcaaacgcgcctgctgacggtctacgagctgttctaggcggtcctcgatgcgctccacctggtcatgctttgcctgcacgtagagcgcaagggtctgctggtaggtctgctcgatgggcgcggattctaagagggcctgctgttccgtctcggcctcctgggccgcctgtagcaaatcctcgccgctgttgccgctggactgctttactgccggggactgctgttgccctgctcgcgccgtcgtcgcagttcggcttgcccccactcgattgactgcttcatttcgagccgcagcgatgcgatctcggattgcgtcaacggacggggcagcgcggaggtgtccggcttctccttgggtgagtcggtcgatgccatagccaaaggtttccttccaaaatgcgtccattgctggaccgtgtttctcattgatgcccgcaagcatcttcggcttgaccgccaggtcaagcgcgccttcatgggcggtcatgacggacgccgccatgaccttgccgccgttgttctcgatgtagccgcgtaatgaggcaatggtgccgcccatcgtcagcgtgtcatcgacaacgatgtacttctggccggggatcacctccccctcgaaagtcgggttgaacgccaggcgatgatctgaaccggctccggttcgggcgaccttctcccgctgcacaatgtccgtttcgacctcaaggccaaggcggtcggccagaacgaccgccatcatggccggaatcttgttgttccccgccgcctcgacggcgaggactggaacgatgcggggcttgtcgtcgccgatcagcgtcttgagctgggcaacagtgtcgtccgaaatcaggcgctcgaccaaattaagcgccgcttccgcgtcgccctgcttcgcagcctggtattcaggctcgttggtcaaagaaccaaggtcgccgttgcgaaccaccttcgggaagtctccccacggtgcgcgctcggctctgctgtagctgctcaagacgcctccctttttagccgctaaaactctaacgagtgcgcccgcgactcaacttgacgctttcggcacttacctgtgccttgccacttgcgtcataggtgatgcttttcgcactcccgatttcaggtactttatcgaaatctgaccgggcgtgcattacaaagttcttccccacctgttggtaaatgctgccgctatctgcgtggacgatgctgccgtcgtggcgctgcgacttatcggccttttgggccatatagatgttgtaaatgccaggtttcagggccccggctttatctaccttctggttcgtccatgcgccttggttctcggtctggacaattctttgcccattcatgaccaggaggcggtgtttcattgggtgactcctgacggttgcctctggtgttaaacgtgtcctggtcgcttgccggctaaaaaaaagccgacctcggcagttcgaggccggctttccctagagccgggcgcgtcaaggttgttccatctattttagtgaactgcgttcgatttatcagttactttcctcccgctttgtgtttcctcccactcgtttccgcgtctagccgacccctcaacatagcggcctcttcttgggctgcctttgcctcttgccgcgcttcgtcacgctcggcttgcaccgtcgtaaagcgctcggcctgcctggccgcctcttgcgccgccaacttcctttgctcctggtgggcctcggcgtcggcctgcgccttcgctttcaccgctgccaactccgtgcgcaaactctccgcttcgcgcctggtggcgtcgcgctcgccgcgaagcgcctgcatttcctggttggccgcgtccagggtcttgcggctctcttctttgaatgcgcgggcgtcctggtgagcgtagtccagctcggcgcgcagctcctgcgctcgacgctccacctcgtcggcccgctgcgtcgccagcgcggcccgctgctcggctcctgccagggcggtgcgtgcttcggccagggcttgccgctggcgtgcggccagctcggccgcctcggcggcctgctgctctagcaatgtaacgcgcgcctgggcttcttccagctcgcgggcctgcgcctcgaaggcgtcggccagctccccgcgcacggcttccaactcgttgcgctcacgatcccagccggcttgcgctgcctgcaacgattcattggcaagggcctgggcggcttgccagagggcggccacggcctggttgccggcctgctgcaccgcgtccggcacctggactgccagcggggcggcctgcgccgtgcgctggcgtcgccattcgcgcatgccggcgctggcgtcgttcatgttgacgcgggcggccttacgcactgcatccacggtcgggaagttctcccggtcgccttgctcgaacagctcgtccgcagccgcaaaaatgcggtcgcgcgtctctttgttcagttccatgttggctccggtaattggtaagaataataatactcttacctaccttatcagcgcaagagtttagctgaacagttctcgacttaacggcaggttttttagcggctgaagggcaggcaaaaaaagccccgcacggtcggcgggggcaaagggtcagcgggaaggggattagcgggcgtcgggcttcttcatgcgtcggggccgcgcttcttgggatggagcacgacgaagcgcgcacgcgcatcgtcctcggccctatcggcccgcgtcgcggtcaggaacttgtcgcgcgctaggtcctccctggtgggcaccaggggcatgaactcggcctgctcgatgtaggtccactccatgaccgcatcgcagtcgaggccgcgttccttcaccgtctcttgcaggtcgcggtacgcccgctcgttgagcggctggtaacgggccaattggtcgtaaatggctgtcggccatgagcggcctttcctgttgagccagcagccgacgacgaagccggcaatgcaggcccctggcacaaccaggccgacgccgggggcaggggatggcagcagctcgccaaccaggaaccccgccgcgatgatgccgatgccggtcaaccagcccttgaaactatccggccccgaaacacccctgcgcattgcctggatgctgcgccggatagcttgcaacatcaggagccgtttcttttgttcgtcagtcatggtccgccctcaccagttgttcgtatcggtgtcggacgaactgaaatcgcaagagctgccggtatcggtccagccgctgtccgtgtcgctgctgccgaagcacggcgaggggtccgcgaacgccgcagacggcgtatccggccgcagcgcatcgcccagcatggccccggtcagcgagccgccggccaggtagcccagcatggtgctgttggtcgccccggccaccagggccgacgtgacgaaatcgccgtcattccctctggattgttcgctgctcggcggggcagtgcgccgcgccggcggcgtcgtggatggctcgggttggctggcctgcgacggccggcgaaaggtgcgcagcagctcgttatcgaccggctgcggcgtcggggccgccgccttgcgctgcggtcggtgttccttcttcggctcgcgcagcttgaacagcatgatcgcggaaaccagcagcaacgccgcgcctacgcctcccgcgatgtagaacagcatcggattcattcttcggtcctccttgtagcggaaccgttgtctgtgcggcgcgggtggcccgcgccgctgtctttggggatcagccctcgatgagcgcgaccagtttcacgtcggcaaggttcgcctcgaactcctggccgtcgtcctcgtacttcaaccaggcatagccttccgccggcggccgacggttgaggataaggcgggcagggcgctcgtcgtgctcgacctggacgatggcctttttcagcttgtccgggtccggctccttcgcgcccttttccttggcgtccttaccgtcctggtcgccgtcctcgccgtcctggccgtcgccggcctccgcgtcacgctcggcatcagtctggccgttgaaggcatcgacggtgttgggatcgcggcccttctcgtccaggaactcgcgcagcagcttgaccgtgccgcgcgtgatttcctgggtgtcgtcgtcaagccacgcctcgacttcctccgggcgcttcttgaaggccgtcaccagctcgttcaccacggtcacgtcgcgcacgcggccggtgttgaacgcatcggcgatcttctccggcaggtccagcagcgtgacgtgctgggtgatgaacgccggcgacttgccgatttccttggcgatatcgcctttcttcttgcccttcgccagctcgcggccaatgaagtcggcaatttcgcgcggggtcagctcgttgcgttgcaggttctcgataacctggtcggcttcgttgtagtcgttgtcgatgaacgccgggatggacttcttgccggcccacttcgagccacggtagcggcgggcgccgtgattgatgatatagcggcccggctgctcctggttctcgcgcaccgaaatgggtgacttcaccccgcgctctttgatcgtggcaccgatttccgcgatgctctccggggaaaagccggggttgtcggccgtccgcggctgatgcggatcttcgtcgatcaggtccaggtccagctcgatagggccggaaccgccctgagacgccgcaggagcgtccaggaggctcgacaggtcgccgatgctatccaaccccaggccggacggctgcgccgcgcctgcggcttcctgagcggccgcagcggtgtttttcttggtggtcttggcttgagccgcagtcattgggaaatctccatcttcgtgaacacgtaatcagccagggcgcgaacctctttcgatgccttgcgcgcggccgttttcttgatcttccagaccggcacaccggatgcgagggcatcggcgatgctgctgcgcaggccaacggtggccggaatcatcatcttggggtacgcggccagcagctcggcttggtggcgcgcgtggcgcggattccgcgcatcgaccttgctgggcaccatgccaaggaattgcagcttggcgttcttctggcgcacgttcgcaatggtcgtgaccatcttcttgatgccctggatgctgtacgcctcaagctcgatgggggacagcacatagtcggccgcgaagagggcggccgccaggccgacgccaagggtcggggccgtgtcgatcaggcacacgtcgaagccttggttcgccagggccttgatgttcgccccgaacagctcgcgggcgtcgtccagcgacagccgttcggcgttcgccagtaccgggttggactcgatgagggcgaggcgcgcggcctggccgtcgccggctgcgggtgcggtttcggtccagccgccggcagggacagcgccgaacagcttgcttgcatgcaggccggtagcaaagtccttgagcgtgtaggacgcattgccctgggggtccaggtcgatcacggcaacccgcaagccgcgctcgaaaaagtcgaaggcaagatgcacaagggtcgaagtcttgccgacgccgcctttctggttggccgtgaccaaagttttcatcgtttggtttcctgttttttcttggcgtccgcttcccacttccggacgatgtacgcctgatgttccggcagaaccgccgttacccgcgcgtacccctcgggcaagttcttgtcctcgaacgcggcccacacgcgatgcaccgcttgcgacactgcgcccctggtcagtcccagcgacgttgcgaacgtcgcctgtggcttcccatcgactaagacgccccgcgctatctcgatggtctgctgccccacttccagcccctggatcgcctcctggaactggctttcggtaagccgtttcttcatggataacacccataatttgctccgcgccttggttgaacatagcggtgacagccgccagcacatgagagaagtttagctaaacatttctcgcacgtcaacacctttagccgctaaaactcgtccttggcgtaacaaaacaaaagcccggaaaccgggctttcgtctcttgccgcttatggctctgcacccggctccatcaccaacaggtcgcgcacgcgcttcactcggttgcggatcgacactgccagcccaacaaagccggttgccgccgccgccaggatcgcgccgatgatgccggccacaccggccatcgcccaccaggtcgccgccttccggttccattcctgctggtactgcttcgcaatgctggacctcggctcaccataggctgaccgctcgatggcgtatgccgcttctccccttggcgtaaaacccagcgccgcaggcggcattgccatgctgcccgccgctttcccgaccacgacgcgcgcaccaggcttgcggtccagaccttcggccacggcgagctgcgcaaggacataatcagccgccgacttggctccacgcgcctcgatcagctcttgcactcgcgcgaaatccttggcctccacggccgccatgaatcgcgcacgcggcgaaggctccgcagggccggcgtcgtgatcgccgccgagaatgcccttcaccaagttcgacgacacgaaaatcatgctgacggctatcaccatcatgcagacggatcgcacgaacccgctgaattgaacacgagcacggcacccgcgaccactatgccaagaatgcccaaggtaaaaattgccggccccgccatgaagtccgtgaatgccccgacggccgaagtgaagggcaggccgccacccaggccgccgccctcactgcccggcacctggtcgctgaatgtcgatgccagcacctgcggcacgtcaatgcttccgggcgtcgcgctcgggctgatcgcccatcccgttactgccccgatcccggcaatggcaaggactgccagcgctgccatttttggggtgaggccgttcgcggccgaggggcgcagcccctggggggatgggaggcccgcgttagcgggccgggagggttcgagaagggggggcaccccccttcggcgtgcgcggtcacgcgcacagggcgcagccctggttaaaaacaaggtttataaatattggtttaaaagcaggttaaaagacaggttagcggtggccgaaaaacgggcggaaacccttgcaaatgctggattttctgcctgtggacagcccctcaaatgtcaataggtgcgcccctcatctgtcagcactctgcccctcaagtgtcaaggatcgcgcccctcatctgtcagtagtcgcgcccctcaagtgtcaataccgcagggcacttatccccaggcttgtccacatcatctgtgggaaactcgcgtaaaatcaggcgttttcgccgatttgcgaggctggccagctccacgtcgccggccgaaatcgagcctgcccctcatctgtcaacgccgcgccgggtgagtcggcccctcaagtgtcaacgtccgcccctcatctgtcagtgagggccaagttttccgcgaggtatccacaacgccggcggccgcggtgtctcgcacacggcttcgacggcgtttctggcgcgtttgcagggccatagacggccgccagcccagcggcgagggcaaccagcccggtgagcgtcggaaaggcgctggaagccccgtagcgacgcggagaggggcgagacaagccaagggcgcaggctcgatgcgcagcacgacatagccggttctcgcaaggacgagaatttccctgcggtgcccctcaagtgtca

SEQ ID NO: 39 - DNA, 1011 bp, Escherichia coli
atgcgctcacgcaactggtccagaaccttgaccgaacgcagcggtggtaacggcgcagtggcggttttcatggcttgttatgactgtttttttggggtacagtctatgcctcgggcatccaagcagcaagcgcgttacgccgtgggtcgatgtttgatgttatggagcagcaacgatgttacgcagcagggcagtcgccctaaaacaaagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgacggtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataa

SEQ ID NO: 40 - DNA, 816 bp, Escherichia coli
atgagccatattcaacgggaaacgtcttgctcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccgggaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaa

SEQ ID NO: 41 - DNA, 795 bp, Escherichia coli
atggttgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgatgatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctga

SEQ ID NO: 42 - DNA, 492 bp, Agrobacterium tumefaciens
atgcactcaaccagattgcgaacaaacgaagtcgcggtcacgctacccgaagaaggcgacgcatcgcttttctttgttggaaagatccggaccccttggaaaagtcgagctgacactcctcggcagggcagtgaatccgggccaccatgcacacttgaaatttcagaaccgtgggccgtggcgctaaagggggtcgaggcgtattcgcaacttgaggttctatattggttgcacgagtcaccacgcgatatcgtcctactaagtcccgctgacgatggagagattcacggtgctttctccctacgagcacctgtgaggcccaatccgatcggaacatcgattgtgaaagtggagagggtatctgggaactcgattgttgtacgtggtcttgattgcctggatggaacaccgctgttggatataaaaccggaccgctcgctatcaaagccgctagccccggtgaggaaaaggttctcgattcctgccgtctga

SEQ ID NO: 43 - DNA, 1269 bp, Agrobacterium tumefaciens
atgattgcgaacagctcttccgatgtctctatggccgaccagaagtttctaaatgtcgcgaagtcaaatgaaatcgatcccgacgccgttcctataagcagacttgattctgaaggtcacagtatttttgcagaatggcgaccgaagcgcccgtttcttcggagagaagatggcgtctttctcgttctccgcgcagaccatatctttctgctgggcaccgatccacgcacccggcaaatagaaactgagctcatgctgaatcgaggcgtcaaagctggtgccgtttttgactttataggtcacagcatgttgttttcgaacggtgaaacgcatgggaagcggcgctcaggtctttcaaaggcgttctcattccgcatggttgaagcgttacgcccggagattgcgaagataacggagcgtttgtgggacgaactacaaaaagttgacgatttcaattttactgaaatgtacgcgtcgcaattgcctgcgctgacgatcgcaagtgtccttggcttgccgtctgaggacacgccgtttttcacacgacttgtttataaggtttcccgctgcttgagcccgtcgtggcgagatgaggaattcgaggagattgaagcttccgctatcgagcttcaggattacgttcggggcgtgatcgcggatagtggccgtcggatgagggatgattttctctcgcgctacttgaaggcggtacgggaagccggaacgctttcgcccattgaggagatcatgcaactcatgcttatcatactcgctgggagcgatacaacgcgcactgcaatggttatggtgacggctcttgtgctccaaaatcccgcgctctggtcttctttaactggcaatcaatcctatgtcgcagccgccgtggaggaagggctccgattcgagccgccagttggctcttttccgcggttggccctcgaggatatcgatctggatggatacgtgttgccaaagggaagcctcctcgcgctcagtgtcatgtctggcctgcgagacgaaaaacactacgagaaccctcatctttttgatgttgggcgtcaacaaatgcgttggcacctcgggtttggcgcgggagttcatcgttgcctcggcgagacgttggctcggattgaattgcaagaaggacttggaacacttttgcgccgcgcgccgaatcttacggtggtaggtgactggccacggatgatgggtcacggaggcatccggcgcgccaccggcatgacggtcaaattgagcgtcgaccggtga

SEQ ID NO: 44 - DNA, 1224 bp, Agrobacterium tumefaciens
gtggaagagaggcgcgtatcaatatcaagcatcacttggagatttccaatgccatgtgcgccagtggacgacgtgacgaccatcgatgacctaacactcgatccctatccgatttatcgcagaatgcgcgtgcaaaacccggtggtacacgtcgcctcggtcagacggacgtttctaacgaaggcctgcgatactaagatggtgaaggatgatccttcacgctttagttctgatgatcccaacacgccgatgaagccggcgcttcaggctcatactttgatgcgtaaggatggagttgaacacgctcgggaacgaatggccatgactagagcattcgcacccaaagcgatcgcggagcattgggtgccgatctatcgtgacatcgtgaacgagtatctagatcgccttccgcgcggagacaccgtggatctttttgcagagatctgtggtccggttgctgctcgcatactggcacatattctaggaatttgtgaggcatcagatgtcgagatgatccgctggtcgcaacggcttattgacggagccggcaacttcggatggcgacccgagctctttgagcgatcggacgaggccaatacggagatgaactgcctcttcaacgacttggtcgaaaaacaccgatccgcgccgaacccctcggcttttgcgatcatgttgaatgcacctgatcctatacccctaagccagatctatgccaacatcaagatcgccatcggcggaggggtcaacgagcctcgtgacgctctcggcacgatcctctatggattgctgaccaatccggagcaactcgaggaggtcaagagacagcaatgctgggggcaggccttcgaggaagggctgcgctgggttgctccgattcaagcgagttcgcgtctcgtgcgggaggaaacggaaattcgtggctttatcgttccgaagggcgacattgtgatgactattcaggcctccgccaatcgtgatgaagatgtctttgaggatggagaaagcttcaatgtctttcgcccgaagaatgcgcatcagtcctttggctccggcccgcatcactgcccaggcgcgcaaatctcgcggcaaaccgtcggcgcgatcatgctgcccatactgttcgatcgatttccggatatgatattgccccaccctgaattagtgcagtggcgcggcttcggcttccgcgggcccattaatctacctgtgacactaagatga

SEQ ID NO: 45 - DNA, 438 bp, Agrobacterium tumefaciens
atgaaacgtatcagtacaatccttgtcggcgtatttttggctgcgccggtttatgcagccgacaatattcatacattagggacgttgtctgaaattgaactagcgctcactgccggaaagccggtgaacgtcacggttgatttaagtttgtgtgctcccggggtggccgatactccggcgacgaaaacgcaaggaggcatgcgcatagatgcgtatcgaataacaactgacggcacccttgcgtttgcagatcagcacttcaccattgaccgtgacggtaaacccataactcaatttattcgttatcagattcggtcaaacggtgacgccgatttcacgatggttacattcaacatgccaacatatgagcgaaaaggtaccagcttggcctacaagtgcgcgatcgaccacgggttgagttttcgtactccacagtga

SEQ ID NO: 46 - DNA, 1134 bp, Agrobacterium tumefaciens
atggatcatcgaaatcgcccgctggacgagagacagcagcactgggttaacagcgtttgggagaggctctgtcgaagcgtcgcattcgcccaacatccagattccgcccgcctgccaatcgcttcatatcaaagtgacatcgcaacaaggctgagagaacacagtgatctcagttcgttcgaaacacgtcccgaatatatgcgagagttttcgaacaagttttcatggaatttaaagcgcgacatttcttttgtggttaatcgcaagagtaagaacggtgaattccgagaagatgcgtttgaagagctgttttgcgaaaggataacgtctgtccatcattctcttcaggaggcgatcacggcacggtttgaatccgccgtcggaaaatcgaatgacgaaggcgatgtacgttctcgcgatgtttcgacattttacgctcgcactgctggggagagttctacaaccaagcgattgaacatcagcacaaacccacgaggcgtggtgccgagtgctgacgtcgtcaatatctctgaacagcaggcacagtctgtcaagtatcggcgtcctaagtttctcgttgaggtctcaaagcacgtctatagaccaatcgaacagtataatcggatggtcttcgatcgagtcagatttccaaacatcactcgtgaccggcgtaagttgaatgtattgatccgcacggaagacggcactggctacgaaacacctagctcgttaaaaacgcgcctgggatcggagcagcataatctcttcaccaagacaatgaacgagggtcagccaccccatagtctcgcgtccacgaagactggtaaactgcctatagttttggttgacgcgggaaatggtgcaacctttatcgccggcgagaaattccctttgttggacaacggacgccggataccaacgactatttctgccgatagaattttagtcagaaatgaaaatgggactttcagcgagctttgtcagcgtttggctggaaacaccgaactattgcttccaccagaagcgatagttcaactgggactgcagcgtcaacaagctgtcaatcgagctcgtgccagagaagcatcggagttggagcaacgaactcgcgaacattcctctggaagagtttga

SEQ ID NO: 47 - DNA, 588 bp, Agrobacterium tumefaciens
atgagagatgatccaggagttgctcgagcgctttccctctcgttacaagataagcacgacattttcgagacccagatcattccggcaatcggtgcgcgggggccgtctgttgcaaagccaactttcaccgttgtatgcggccagcagggtgccggaaagagcaccttagttcgccaaatcaagagtagaacgggcggtgaaagcacccagcgaataatagctgatgatcttaatgcatacattcctggtaacaatgcagcccttctgcagggctcgcatgcgttagagcgagcgaattcgacggcagtgacagaatggtatcatcaattatttgatcgcagtatcactaatagatataatattatactggagtcttgctatccgccaaatcattacgcgtcgctcttagataaggcgcgctccaatggatacagaacagaactaaatattatcgcgacggacaggataacgagctttacagctattcacgatcgctttgaaagggcactggcgaactcgtttattgcctcaaccgtattgccagatgtcgaaactcacgatcattattattcatttggccacgtgtag

SEQ ID NO: 48 - DNA, 633 bp, Agrobacterium tumefaciens
atggctaaaaatgatgcttataagctaattatatttgattttgatggtacattggccgacagcggcgcctggatgatacgcgctctgagggaaatgtccgaacgtcaccgattcgtatcgcccagcgacactcagattgaatatctgcgtggcctttcagtttgccaggttctgaagtggatgagagtaccggtgtggcgcattcctctgatcgtgagagacttgcgtaaactggctcgcgaagccacgttcgatatgttccctaggacagaaaaggtcttgtttctcctccaagatcaaggggtcgagcttgcaatcttaagttcgaacagcgttgaaaatattcagcgcgtgctcgggccattggagagatactttgcttatatagagggcagctcgccaatatttgggaagggcaaaaggatcaataagatacttcgtcggtttgaaaggtcccggaatgaagtgcttcttgtcggagatgaggtacgtgatattgaggcagcgatgagtcaaaacgttgcctccgcgggagttacgtggggttatgctaagagagaggctttggcgtgcagcaatcccacgcacatcctagaagatattgaggaactaatagacttgaaacctctctaa

SEQ ID NO: 49 - DNA, 213 bp, Agrobacterium tumefaciens
atgaaaacgtcgaccaaaacaatgcttgtctacgccgcgataattttcactccaggatttatatattttccactatataaaattttgctcactctttatagtgaagattcaggagatacatatttttgtcagttctatacggagttctcatttttttggataatgggattactggtttttgccttgtcaacgatgcttaaaaagaagccttag

SEQ ID NO: 50 - DNA, 2101 bp, Salmonella tymphimurium
gacagtaagacgggtaagcctgttgatgataccgctgccttactgggtgcattagccagtctgaatgacctgtcacgggataatccgaagtggtcagactggaaaatcagagggcaggaactgctgaacagcaaaaagtcagatagcaccacatagcagacccgccataaaacgccctgagaagcccgtgacgggcttttcttgtattatgggtagtttccttgcatgaatccataaaaggcgcctgtagtgccatttacccccattcactgccagagccgtgagcgcagcgaactgaatgtcacgaaaaagacagcgactcaggtgcctgatggtcggagacaaaaggaatattcagcgatttgcccgagcttgcgagggtgctacttaagcctttagggttttaaggtctgttttgtagaggagcaaacagcgtttgcgacatccttttgtaatactgcggaactgactaaagtagtgagttatacacagggctgggatctattctttttatctttttttattctttctttattctataaattataaccacttgaatataaacaaaaaaaacacacaaaggtctagcggaatttacagagggtctagcagaatttacaagttttccagcaaaggtctagcagaatttacagatacccacaactcaaaggaaaaggactagtaattatcattgactagcccatctcaattggtatagtgattaaaatcacctagaccaattgagatgtatgtctgaattagttgttttcaaagcaaatgaactagcgattagtcgctatgacttaacggagcatgaaaccaagctaattttatgctgtgtggcactactcaaccccacgattgaaaaccctacaaggaaagaacggacggtatcgttcacttataaccaatacgctcagatgatgaacatcagtagggaaaatgcttatggtgtattagctaaagcaaccagagagctgatgacgagaactgtggaaatcaggaatcctttggttaaaggctttgagattttccagtggacaaactatgccaagttctcaagcgaaaaattagaattagtttttagtgaagagatattgccttatcttttccagttaaaaaaattcataaaatataatctggaacatgttaagtcttttgaaaacaaatactctatgaggatttatgagtggttattaaaagaactaacacaaaagaaaactcacaaggcaaatatagagattagccttgatgaatttaagttcatgttaatgcttgaaaataactaccatgagtttaaaaggcttaaccaatgggttttgaaaccaataagtaaagatttaaacacttacagcaatatgaaattggtggttgataagcgaggccgcccgactgatacgttgattttccaagttgaactagatagacaaatggatctcgtaaccgaacttgagaacaaccagataaaaatgaatggtgacaaaataccaacaaccattacatcagattcctacctacataacggactaagaaaaacactacacgatgctttaactgcaaaaattcagctcaccagttttgaggcaaaatttttgagtgacatgcaaagtaagtatgatctcaatggttcgttctcatggctcacgcaaaaacaacgaaccacactagagaacatactggctaaatacggaaggatctgaggttcttatggctcttgtatctatcagtgaagcatcaagactaacaaacaaaagtagaacaactgttcaccgttacatatcaaagggaaaactgtccatatgcacagatgaaaacggtgtaaaaaagatagatacatcagagcttttacgagtttttggtgcattcaaagctgttcaccatgaacagatcgacaatgtaacagatgaacagcatgtaacacctaatagaacaggtgaaaccagtaaaacaaagcaactagaacatgaaattgaacacctgagacaacttgttacagctcaacagtcacacatagacagcctgaaacaggcgatgctgcttatcgaatcaaagctgccgacaacacgggagccagtgacgcctcccgtggggaaaaaatcat

SEQ ID NO: 51 - DNA, 1554 bp, Escherichia coli
atggaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccttaataagatgatcttcttgagatcgttttggtctgcgcgtaatctcttgctctgaaaacgaaaaaaccgccttgcagggcggtttttcgaaggttctctgagctaccaactctttgaaccgaggtaactggcttggaggagcgcagtcaccaaaacttgtcctttcagtttagccttaaccggcgcatgacttcaagactaactcctctaaatcaattaccagtggctgctgccagtggtgcttttgcatgtctttccgggttggactcaagacgatagttaccggataaggcgcagcggtcggactgaacggggggttcgtgcatacagtccagcttggagcgaactgcctacccggaactgagtgtcaggcgtggaatgagacaaacgcggccataacagcggaatgacaccggtaaaccgaaaggcaggaacaggagagcgcacgagggagccgccaggggaaacgcctggtatctttatagtcctgtcgggtttcgccaccactgatttgagcgtcagatttcgtgatgcttgtcaggggggcggagcctatggaaaaacggctttgccgcggccctctcacttccctgttaagtatcttcctggcatcttccaggaaatctccgccccgttcgtaagccatttccgctcgccgcagtcgaacgaccgagcgtagcgagtcagtgagcgaggaagcggaatatatcctgtatcacatattctgctgacgcaccggtgcagccttttttctcctgccacatgaagcacttcactgacaccctcatcagtgccaacatagtaagccagtatacactccgctagcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccacgttgtgtctcaaaatctctgatgttacattgcacaagataaaaatatatcatcatgaacaataaaactgtctgcttacataaacagtaatacaaggggtgtt

SEQ ID NO: 52 - DNA, 1576 bp, Escherichia coli
gatcgctagtttgttttgactccatccattagggcttctaaaacgccttctaaggccatgtcagccgttaagtgttcctgtgtcactgaaaattgctttgagaggctctaagggcttctcagtgcgttacatccctggcttgttgtccacaaccgttaaaccttaaaagctttaaaagccttatatattcttttttttcttataaaacttaaaaccttagaggctatttaagttgctgatttatattaattttattgttcaaacatgagagcttagtacgtgaaacatgagagcttagtacgttagccatgagagcttagtacgttagccatgagggtttagttcgttaaacatgagagcttagtacgttaaacatgagagcttagtacgtgaaacatgagagcttagtacgtactatcaacaggttgaactgctgatcttcagatctagcttaaaacaggtggctttttaatcatctttgccaagcatggcgcgggtttggggtaatatagcgactcataaaagcgttaaacatgagtggatagtacgttgctaaaacatgagataaaaattgactctcatgttattggcgttaagatatacagaatgatgaggtttttttatgagactcaaggtcatgatggacgtgaacaaaaaaacgaaaattcgccaccgaaacgagctaaatcacaccctggctcaacttcctttgcccgcaaagcgagtgatgtatatggcgcttgctcccattgatagcaaagaacctcttgaacgagggcgagttttcaaaattagggctgaagaccttgcagcgctcgccaaaatcaccccatcgcttgcttatcgacaattaaaagagggtggtaaattacttggtgccagcaaaatttcgctaagaggggatgatatcattgctttagctaaagagcttaacctgccctttactgctaaaaactcccctgaagagttagatcttaacattattgagtggatagcttattcaaatgatgaaggatacttgtctttaaaattcaccagaaccatagaaccatatatctctagccttattgggaaaaaaaataaattcacaacgcaattgttaacggcaagcttacgcttaagtagccagtattcatcttctctttatcaacttatcaggaagcattactctaattttaagaagaaaaattattttattatttccgttgatgagttaaaggaagagttaacagcttatacttttgataaagatggaaatattgagtacaaataccctgactttcctatttttaaaagggatgtgttaaataaagccattgctgaaattaaaaagaaaacagaaatatcgtttgttggcttcactgttcatgaaaaagaaggaagaaaaattagtaagctgaagttcgaatttgtcgttgatgaagatgaattttctggcgataaagatgatgaagctttttttatgaatttatctgaagctgatgcagcttttctcaaggtatttgatgaaaccgtacctcccaaaaaagctaaggggtgatatatggctaaaatttacgatttccctcaaggagcc

SEQ ID NO: 53 - DNA, 2400 bp, Escherichia coli
cacctaaacgaaggccgggccactcacccggccttttttgtacgctcatagggcagaacaaaccaacgttttatctataccgctacagggtatttaattcctatttaatctgcgctagaatgaggcatgtttaaccgaatctgacgttttccctgcaaatgccaaaatactatgcctatctccgggtttcgcgtgacggccaagacccggaaaaccaaaaatacggtttgctcgaatacgcgaacgccaaaggcttcgcgccgctacagatcgaggaagaaattgccagcagagcaaaggactggcgcaagcgcaagctcggagcaatcatcgaaaaggccgagcgtggcgacgtgctactgacgccggagattacgcgcattgccggttccgccctcgccgccttggaaattctcaaagcggcgagcgagcgcggcctaatcgtccatgtgaccaaacagaagatcatcatggacggcagcctacaaagcgacatcatggcaaccgtgcttggcttggctgcacagatcgagcggcatttcattcaggcacgtaccaccgaggcgctacaagtcgccagagagcgcggcaagacgctcgggcgacccaagggcagcaaatcgagcgccttgaagctggacagccgtattgatgaagtacaggcatacgtgaaccttggcttgccgcaaagtcgcgcagccgagttgttaggcgtcagccctcacaccttgcgcctgttcatcaaacgccggaacatcaaacccacaaacactagaccaaccatcaccatgccggggagggaacaacatgcctaagaacaacaaagcccccggccatcgtatcaacgagatcatcaagacgagcctcgcgctcgaaatggaggatgcccgcgaagctggcttagtcggctacatggcccgttgccttgtgcaagcgaccatgccccacaccgaccccaagaccagctactttgagcgcaccaatggcatcgtcaccttgtcgatcatgggcaagccgagcatcggcctgccctacggttctatgccgcgcaccttgcttgcttggatatgcaccgaggccgtgcgaacgaaagaccccgtgttgaaccttggccggtcgcaatcggaatttctacaaaggctcggaatgcacaccgatggccgttacacggccacccttcgcaatcaggcgcaacgcctgttttcatccatgatttcgcttgccggcgagcaaggcaatgacttcggcattgagaacgtcgtcattgccaagcgcgcttttctattctggaatcccaagcggccagaagatcgggcgctatgggatagcaccctcaccctcacaggcgatttcttcgaggaagtcacccgctcaccggttcctatccgaatcgactacctgcatgccttgcggcagtctccgcttgcgatggacatttacacgtggctgacctatcgcgtgttcctgttgcgggccaagggccgccccttcgtgcaaatcccttgggtcgccctgcaagcgcaattcggctcatcctatggcagccgcgcacgcaactcgcccgaactggacgataaggcccgagagcgggcagagcgggcagcactcgccagcttcaaatacaacttcaaaaagcgcctacgcgaagtgttgattgtctatcccgaggcaagcgactgcatcgaagatgacggcgaatgcctgcgcatcaaatccacacgcctgcatgtcacccgcgcacccggcaagggcgctcgcatcggcccccctccgacttgaccaggccaacgctacgcttggcttggtcaagccttcccatccaacagcccgccgtcgagcgggcttttttatccccggaagcctgtggatagagggtagttatccacgtgaaaccgctaatgccccgcaaagccttgattcacggggctttccggcccgctccaaaaactatccacgtgaaatcgctaatcagggtacgtgaaatcgctaatcggagtacgtgaaatcgctaataaggtcacgtgaaatcgctaatcaaaaaggcacgtgagaacgctaatagccctttcagatcaacagcttgcaaacacccctcgctccggcaagtagttacagcaagtagtatgttcaattagcttttcaattatgaatatatatatcaattattggtcgcccttggcttgtggacaatgcgctacgcgcaccggctccgcccgtggacaaccgcaagcggttgcccaccgtcgagcgccagcgcctttgcccacaacccggcggccgcaacagatcgttttataaatttttttttttgaaaaagaaaaagcccgaaaggcggcaacctctcgggcttctggatttccgatcaacgcaggagtcgttcggaaagtagctgttccagaa

SEQ ID NO: 54 - DNA, 599 bp, Escherichia coli
cggcgttgtggatacctcgcggaaaacttggccctcactgacagatgaggggcggacgttgacacttgaggggccgactcacccggcgcggcgttgacagatgaggggcaggctcgatttcggccggcgacgtggagctggccagcctcgcaaatcggcgaaaacgcctgattttacgcgagtttcccacagatgatgtggacaagcctggggataagtgccctgcggtattgacacttgaggggcgcgactactgacagatgaggggcgcgatccttgacacttgaggggcagagtgctgacagatgaggggcgcacctattgacatttgaggggctgtccacaggcagaaaatccagcatttgcaagggtttccgcccgtttttcggccaccgctaacctgtcttttaacctgcttttaaaccaatatttataaaccttgtttttaaccagggctgcgccctgtgcgcgtgaccgcgcacgccgaaggggggtgcccccccttctcgaaccctcccggcccgctaacgcgggcctcccatccccccaggggctgcgcccctcggccgcgaacggcctcaccccaaaaatggcagcgc

SEQ ID NO: 55 - DNA, 801 bp, Escherichia coli
tgcgcgtcccccttggtcaaattgggtatacccatttgggcctagtctagccggcatggcgcattacagcaatacgcaatttaaatgcgcctagcgcattttcccgaccttaatgcgcctcgcgctgtagcctcacgcccacatatgtgctaatgtggttacgtgtattttatggaggttatccaatgagccgcctgacaatcgacatgacggaccagcagcaccagagcctgaaagccctggccgccttgcagggcaagaccattaagcaatacgccctcgaacgtctgttccccggtgacgctgatgccgatcaggcatggcaggaactgaaaaccatgctggggaaccgcatcaacgatgggcttgccggcaaggtgtccaccaagagcgtcggcgaaattcttgatgaagaactcagcggggatcgcgcttgacggcctacatcctcacggctgaggccgaagccgatctacgcggcatcatccgctacacgcgccgggagtggggcgcggcgcaggtgcgccgctatatcgctaagctggaacagggcatagccaggcttgccgccggcgaaggcccgtttaaggacatgagcgaactctttcccgcgctgcggatggcccgctgcgaacaccactacgttttttgcctgccgcgtgcgggcgaacccgcgttggtcgtggcgatcctgcatgagcgcatggacctcatgacgcgacttgccgacaggctcaagggctgatttcagccgctaaaaatcgcgccactcacaacgtcctgatggcgtactaagctggg

SEQ ID NO: 56 - DNA, 3208 bp, Artificial sequence
  Synthetic construct
cccagcttagtacgccatcaggacgttgtgagtggcgcgatttttagcggctgaaatcagcccttgagcctgtcggcaagtcgcgtcatgaggtccatgcgctcatgcaggatcgccacgaccaacgcgggttcgcccgcacgcggcaggcaaaaaacgtagtggtgttcgcagcgggccatccgcagcgcgggaaagagttcgctcatgtccttaaacgggccttcgccggcggcaagcctggctatgccctgttccagcttagcgatatagcggcgcacctgcgccgcgccccactcccggcgcgtgtagcggatgatgccgcgtagatcggcttcggcctcagccgtgaggatgtaggccgtcaagcgcgatccccgctgagttcttcatcaagaatttcgccgacgctcttggtggacaccttgccggcaagcccatcgttgatgcggttccccagcatggttttcagttcctgccatgcctgatcggcatcagcgtcaccggggaacagacgttcgagggcgtattgcttaatggtcttgccctgcaaggcggccagggctttcaggctctggtgctgctggtccgtcatgtcgattgtcaggcggctcattggataacctccataaaatacacgtaaccacattagcacatatgtgggcgtgaggctacagcgcgaggcgcattaaggtcgggaaaatgcgctaggcgcatttaaattgcgtattgctgtaatgcgccatgccggctagactaggcccaaatgggtatacccaatttgaccaagggggacgcgcaatctaggttctggaacagctactttccgaacgactcctgcgttgatcggaaatccagaagcccgagaggttgccgcctttcgggctttttctttttcaaaaaaaaaaatttataaaacgatctgttgcggccgccgggttgtgggcaaaggcgctggcgctcgacggtgggcaaccgcttgcggttgtccacgggcggagccggtgcgcgtagcgcattgtccacaagccaagggcgaccaataattgatatatatattcataattgaaaagctaattgaacatactacttgctgtaactacttgccggagcgaggggtgtttgcaagctgttgatctgaaagggctattagcgttctcacgtgcctttttgattagcgatttcacgtgaccttattagcgatttcacgtactccgattagcgatttcacgtaccctgattagcgatttcacgtggatagtttttggagcgggccggaaagccccgtgaatcaaggctttgcggggcattagcggtttcacgtggataactaccctctatccacaggcttccggggataaaaaagcccgctcgacggcgggctgttggatgggaaggcttgaccaagccaagcgtagcgttggcctggtcaagtcggaggggggccgatgcgagcgcccttgccgggtgcgcgggtgacatgcaggcgtgtggatttgatgcgcaggcattcgccgtcatcttcgatgcagtcgcttgcctcgggatagacaatcaacacttcgcgtaggcgctttttgaagttgtatttgaagctggcgagtgctgcccgctctgcccgctctcgggccttatcgtccagttcgggcgagttgcgtgcgcggctgccataggatgagccgaattgcgcttgcagggcgacccaagggatttgcacgaaggggcggcccttggcccgcaacaggaacacgcgataggtcagccacgtgtaaatgtccatcgcaagcggagactgccgcaaggcatgcaggtagtcgattcggataggaaccggtgagcgggtgacttcctcgaagaaatcgcctgtgagggtgagggtgctatcccatagcgcccgatcttctggccgcttgggattccagaatagaaaagcgcgcttggcaatgacgacgttctcaatgccgaagtcattgccttgctcgccggcaagcgaaatcatggatgaaaacaggcgttgcgcctgattgcgaagggtggccgtgtaacggccatcggtgtgcattccgagcctttgtagaaattccgattgcgaccggccaaggttcaacacggggtctttcgttcgcacggcctcggtgcatatccaagcaagcaaggtgcgcggcatagaaccgtagggcaggccgatgctcggcttgcccatgatcgacaaggtgacgatgccattggtgcgctcaaagtagctggtcttggggtcggtgtggggcatggtcgcttgcacaaggcaacgggccatgtagccgactaagccagcttcgcgggcatcctccatttcgagcgcgaggctcgtcttgatgatctcgttgatacgatggccgggggctttgttgttcttaggcatgttgttccctccccggcatggtgatggttggtctagtgtttgtgggtttgatgttccggcgtttgatgaacaggcgcaaggtgtgagggctgacgcctaacaactcggctgcgcgactttgcggcaagccaaggttcacgtatgcctgtacttcatcaatacggctgtccagcttcaaggcgctcgatttgctgcccttgggtcgcccgagcgtcttgccgcgctctctggcgacttgtagcgcctcggtggtacgtgcctgaatgaaatgccgctcgatctgtgcagccaagccaagcacggttgccatgatgtcgctttgtaggctgccgtccatgatgatcttctgtttggtcacatggacgattaggccgcgctcgctcgccgctttgagaatttccaaggcggcgagggcggaaccggcaatgcgcgtaatctccggcgtcagtagcacgtcgccacgctcggccttttcgatgattgctccgagcttgcgcttgcgccagtcctttgctctgctggcaatttcttcctcgatctgtagcggcgcgaagcctttggcgttcgcgtattcgagcaaaccgtatttttggttttccgggtcttggccgtcacgcgaaacccggagataggcatagtattttggcatttgcagggaaaacgtcagattcggttaaacatgcctcattctagcgcagattaaataggaattaaataccctgtagcggtatagataaaacgttggtttgttctgccctatgagcgtacaaaaaaggccgggtgagtggcccggccttcgtttaggtg

SEQ ID NO: 57 - DNA, 3754 bp, Agrobacterium rhizogenes
atgcgttatcttgagacggcaataacgcgtctgacgctaataaaccgtctgaaacctgaggcccaagtgaacgtgatcgaccggcacattaatcgagcatcaacttccgcacacatcacccagcgcgcggaagcgttgtctgcgagactcagggcggttggtgagcgcgcgtttccccctaccgcacaaaagtcgcttcgatctttcacttccggcgaggtcgccgaaattgtcggcgtgtcagacggctatcttcgccagctttcgctcgatggactcggcccttcgccagatttgggaagcgccggtcgccgctcttacactttggagcaaatcaatcaactccgtgagtatcttgccggagctcgacctaaggaagcaagtagattttggccacgtcggcgcagtggcgaaaaacttcaagtgatcacggtcgcaaatttcaaaggcggctccgcgaagacaacaactgctgtttatctcgcacaaggacttgcgttgcagggctaccgtgtcttggcggttgatcttgatcctcaggcttccctctccgcaatgttcggttatcagccagagttcgacgttgccgaaaacacgaccctttatggtgcgatccgctacgacgaccagagggtgacgatgaaggacgttatccggcgcacctactttaccgggataagcattgtcccgggtaatctcgaactgatggagtttgaacatcagacccctcgattcatgctgcagaatcgagggcgtccggaggatctatttttcagacgtgtcgcaggcgcaatcaatcaggtcgaacaggacttcgacgtcgttgtcgtcgattgccccccacaactgggctttttgaccatgggcgcccttaacgcagcgagtggcatgattgtgactgtccatccccaaatggtcgatgtcgcatccatgagccagttcctcttgatgacgtccgatctcgtgtcggtaattgaagaagccggcggacggctcgactacgactttctaaggtttcttattacgaggcatgatccgcgcgacgtccccgagcaggaaatcgtggcgctgcttcgtgacgtcttcggaaccgacgtcatggcggcatccgcatggaagtcgacggcaatcgccaatgccggtcttaccaagcagtcgctctatgaactctcgcgcggcgcggtaggacggacgacgtatgatcgagcaatggaatccatcaatgccgtgaatctggaaattatcgaccagataaacaaggtctggggtcgatgatggcggctcaatcgctgataaatcaaaaccttagtgtgttgtcagctgactacacggtcttactagaactgttgtttggatagggtcgaaacgatgagcaaacgcacacaatccattcgctcaatgtttgccgggggcaacgatcagaccgcttctaatgacgcacagcagcctgtgcagcgagttgcctcgggtgcggtccggtcgttgaaagacacgttctcagaggtggaaagacattacgaagagctcaagcagcaagttgctgacggagctgttccagtcgaaatagacccagaattggtcgacccctcgcccttcgcggaccggtttgcggaccaagacatggctgtcttggaggtccttaagacttcgatcaaagatcatggacaagaaattccgatccttgttcgaccgcatccagctgagatcggacgatatcaggttgcctacggccaccgcagactacgtgcgactgccgaactcggcttgaaagtcaaagcctatgtccgcgaactggatgacgatcgtcttgtcgtcgcgcagggcatcgagaattccgctcgtgaagacctgactttcatcgaacgggcggcgtttgcactcaaactggacgagggtggttttcaacggtcgctaatacaaatggctttgtctgttgaccgacacgaagctcaaaagctggtaacagttgctcgggcagttccgcagtggttgattgattccattggccgtgcgccgaagatcggtcgaccgaggtggctggagctcgcagaacttttgaaagtcccgggcgcagagaagaaggcccgcaaagccacccaggacaaatccttctcacataaggattctgacaatcgtttcctggtcgtcctaagagcgtccaagatagatgatgtgacggcgtcgtctgtagcccccacccgcttggtcgcaaaatctgctgacgggcttcaaatcgcgacgctcgccatcggcggcaagcagtgcaaaatcgaaatgaaccgagatagagacgagacttttgcaaagtttgttatggagcagcttcctgcgctctacgcgaacttcagaaaggaaaatccgtcatctgaaggataaataaggataggaacagcaaaagaaaggcccccaaacgtcgccgtcgtggaagcctctctcaatggtctaagcagcctgagaatcgcatttccatgaatcgcagtcaagagtctttggcaccgtttttggtgagcagatttcttttgcctattgaagggtgaaagacatgcagagtggaaatgtgacgacgccgtttgggcggcggccgatgacgcttgccttagtggcggcacagttcaaatccgccgacatcaggcagggtaaatcggccgacaagtggaagatctatcgcgatgcttgtgacgcgcgatcattgttgggtttgcgcgatcgggcacttgcagtgctcaacgcgcttctatcattctaccctgaggctgaactcaaggaggaagcgaatcttatcgtgtttccgtccaatgcccaactcgcggcacgggcaaacggtatcgccggcacgacgctacgcgagaacttggccctcttggtcgatgcaggtctcgtccaacggaatgatagcccgaacgggaaacgctatgcgcgcaagagctcagatgggtccatcgagacagcctttggcttcagtctagcgccgcttctggcccgatcagaagaacttgcggttatggcccagcaggtcgcagagggtaatcgcaagctcaaaatcgtcaaagagcgcatcacaattgcccgacgggatgtccggaaattgatctctgcggcaatggaagatcacgttcccggggattgggccaaggtcgaggagctttatgttgaagccatggcacggctgcggcgggcaaaaggggcggacgaattgatcggaattctcgacgaagtcgagatgctgaaggaagaagtagtcaatctattggaacggcacgtcaatcttgaaaaatccgacgccaatgatgacggattccgtcagcacatacagaattcaaataccgaatccagcaatgaacttgaaccttgctctgaaaacgagcagggcgcgaagcagagtaaaaacgttgaactaagagccgaatcgataaaatcattcccgcttggtatggtccttcgggcatgcccggagatttccatgtatggtccgggcggagcaatcggcagctggcgggaccttatgatggccgccgtggtcgtgcgatcaatgctgggggtaagcccgtcggcctaccaggacgcctgcgaagtaatagggcctgaaaacgcggccgcaatgatggctgcaatcctggagcgggcggggcacatcacatcggccggtggatatcttcgcgatttgacgtcgagggcaaaacgcggcgagttttctctcggaccaatgttgatggcgttgctgcgggccaatggcggcgaacaaaggcgggcttaa

SEQ ID NO: 58 - DNA, 3992 bp, Agrobacterium tumefaciens
gtgagcaaagccgctgccatatcccgaaatgatcgcccgtcggtagatgttaccattggtgagcatgctgagcagctcagctctcagcttcaagcgatgagcgaggctttgtttcctccgacgtcgcacaagagcttgcgcaaattcacctcgggtgaagccgcacgcttgatgaaaatatctgactcaactcttcgaaagatgacactggctggcgaagggccgcaacctgaactcgccagcaacggacggcgcttttacaccctcggtcagataaacgaaatccggcagatgcttgccggctcgactcgaggacgtgaaagcattgattttgtgcctcatcgccgaggttctgagcatttgcaagtcgttgctgtaaccaacttcaaaggtggctctgggaagacgacgacgtccgctcatcttgcacagtatctggcgttgcaaggttacagggttctcgcagtcgatctcgatccgcaggctagtctttcagcactcctcggcgttctgccagaaactgatgtcggtgcaaacgaaacgctctatgcggctattcggtacgacgacacacgtcgtccgttgcgagatgtgatccgaccgacgtattttgatggtcttcaccttgttcctggaaatctcgagcttatggagttcgagcataccaccccgaaagcattgactgacaaaggtacgcgcgacggattgttcttcactcgcgtggcccaagcctttgatgaggtcgccgacgattacgatgtcgtggtcatcgactgccctcctcagcttgggtttttgactctcagcgggttgtgtgctgcaacatcaatggtaatcaccgtacatcctcagatgctggatatcgcttccatgagccagtttctcctcatgacacgcgaccttctgggtgtcgtgaaagaggcggggggcaatctccagtacgatttcatacgctatctcttgacgcgctatgagccccaggacgcgccgcagacgaaagtgacggcactgctgcgcaacatgttcgaggatcacgtccttacaaatcctatggtcaagtcggcagcggtatctgatgccggtttaaccaagcagacgctctatgagatagggcgagagaaccttacgcgatcgacatacgaccgggcgatggaatctttagatgcggtgaattcggagatcgaggctttgatcaagatggcgtgggggcgggtctaatgaaaggctttgcgttcctcacagatctgttgggagctcccaacagacaggtgttgattcgccccctggacatggggcactggagaagccggggtaatttgagacgacgacgcacgcccatcgctaattggccagggtgcagttgtcttgtcttgttgggagctcccaaccaagcgcatttgcaatcaaaaatgcgacgccacgacgccaaacccaagaggctgatatcatgagccgcaaagacgcaatcgatactttgttcctcaagaagcaacctgcgaccgatagagcagcagtcgacaagtcgaccgctcgtgttcgtaccggagcgatttcggccatgggttcgtctttgcaagagatggctgagggcgcaaaggctgcagctcggctgcaggatcaactggctacaggcgaagccgtcgtgtccctggatccatccatgatcgacgggtcgccgatcgcggatcggctgccctcagacgtggatccgaaattcgagcagcttgaggcgagcatttcgcaggaggggcagcaggtgccggttcttgtcagaccgcaccctgaggctgccggtcgatatcagatcgtatatggaaggcggcggctgcgcgcggcagtaaatctgcggagagaggtttctgccattgttcgaaatctcacggactgtgaactggtcgtggcccagggccgcgaaaatcttaaccgtgctgacctctcgttcattgagaaggctctcttcgccctgcgcctcgaagatgcgggttttgatagagccaccatcattgccgcgctatccactgacaaggccgacctcagccgctacataactgtagcaaggggcataccgctgaacctcgccacacaaatcggcccagcgtcgaaagcgggtcgatcgcgttgggtcgcacttgccgaggggcttgggaagcctaaggcaacggacgcaatcgaagcgatgcttgggtcagagcagttcaagcaatctgatagcgatacccgctttaacctcattttcaacgccgtttcaaggccacctgcgaagactccaaaaaaggtaagggcctggagcacgccaaaggggaaaaaggcagcgacgatccgacaagaaactggacgaacggcgctggttttcgacgagagactggtgccaacttttggcgaatatgtcgctgaccagttggacagtctgtacgcccagttcattgaaaccaacggaggaggcaagctcgaccaatagtcagggtttcatccaatttaaagctccgctcgactgagatggactggctctcaccgcaaaagaaaaaggcccccgaaacggcgttccggaagaccttctctgtagtctcgcagctaagagaatcgcatttccaggaatcgtagtcaagggtcccgtaagggaaagcgtcatttcgacgggcggatttcaattgcctaacaaaaggtaaaaggaaatgcagacgcatatctcaacgacgtcctttgggcggcggccgatgacactcggccatattgcaagccagatggcagcaaaagcggtcgcatcagacactgtcgcccacaaatggcaggtcttccagcacatccgtgaatcccggggactgatcggagccacggaccgctcactctcgatcctgaacgcgctgttgacgttttacccggagaccgccttgactggtggtgccgaactggtcgtatggccttctaacgaacagctgatggctcgcgccaacggcatgcccgccacgacactgcgccggcatcttgccatactggttgattgcgggctcatcattcgccgcgacagccccaatggcaagcggttcgcccgcaagggaaggggaggggagattgagcaggcctatgggttcgatctgtcgccgatcgtcgcgcgggccgaggagttccgagatctggcccagacagtgcaagctgaaaaaaaggccttccgggtggccaaggagcgcttgactcttcttcgtcgtgacattgtcaaaatgatcgaaactggcgtcgaagagagcgttcctggaaactggggaagagttacccagacctatcaggggatcatcggccgcctgccacgctcggcacctcggcagcttgtcgagagtattgggcaagagcttcaggaactttgcatcgagatccgtgacgtattggaatctttcacaaaaacgatgaatctggacgccaatgagtcccatatcggtcgccacaaacagaattcaaatccagactctaaatttgaatctgaatacggctctggaaaaaaagatgaagcgggcggcagcgttgcggaaaccgacaatgtacggagcttgccgaaacgcgagctgcctttgggaatcgtgctggatgcctgccccgaaatgcgggaattggcccagggaggtccaattcgacattggcgcgacttgctggcggcggctgagcttgcccggccgatgctggggattagtccgagcgcctggcgggaggcccgcgaaaccatgggcgagcaacacgcggcgatcacgctggcttcgatctatcagcgggccggtcagatcaataacgctgggggctatctgcgcagcctgaccgaccgggccaaggatgggaagttttcgacctggccgatggtcatggcgttgctccgggcgaagctggacgagcagaagaatgcagtcggcgctggaaagccgcgaactgctgaggaggtcgaggatgacagccgcctccacgtatcggaatcgctgctcaaaaacctgcgaaagccgagatcttggtga

SEQ ID NO: 59 - DNA, 865 bp, Ruegeria sp.
gcgccggctggtaatcgatgatgatgcaatccagcgtttcgttcagcgcctgctcgagacggacaggatcgacctttccatctgcaacaagttcgttgggagccgttgccggcggatacgcctctttccagcgatcaatcgcatcccgcagatagcgatagaaactcttccccgcaggcgcttcgcgaaccaagcgggcgatctgaatttcgccctcagaagtctctccgtgcgccggcaccaatcgaagccccggccaagaagtcttcaaaaagaagctatccagcgtctccgcagagtgatccgtgtacggcgcctcctcagactggaagaggcctgcgaagtccaccatcgatggcgtctcttcagtaggcatctgagacaaaccctcaccgcctacaaagtaaagtgtgatcgtgctttgcggatccgcatccatcacaccaacgcgcattccgtagtgcaagctcaggtactgagcgaaatgtgcagcgctaaggctcttggctgtgccgcccttttggctggcaaatgaaatgaccggaagcggatcgccgggcttgcgccacgctagatagtcaaaagggcgctttgcagacgccgccatcaaagcgcgcatatgcatcagttcgtgaagattgaagacacgctcgcgtccgacgtactcaccctttggaaagtcgtcgttgccattcgcaaacttagtcaagtattggatgctgacgttcaaaaagcgagcgcactgtcgcatcgaccatgtacgcttgatacgatggcgcaacgtcaactctttgttgacggcgaccattgtgcgctccagacctcgtgacaggtcggtcaaaaactgttctagacttccgctcat

SEQ ID NO: 60 - DNA, 3120 bp, Sinorhizobium fredii
atgaacgctaattcgccgcccatcgctcccgcacagccgatgcatttcgaggatctcatcctcgaacagggcgatctgatttcaaagaaattgcatcttttaagcatgcagcagttcccaccgaatgccaagaaactgcttcgccagttctcgctctctgaagtggcgcagttcctcggcgtctctcaaagtacgctgaagaaacttcatcttgagggaaaaggccccctcccccagacatcgtcgtcgggtcgccgttcttatagtgctgagcagatggcggaactgcgtcagtatctcgatcagcatggacgatcggaagccaggaactacgtgccgcaccgtcggtcgggcgaaaagctccaggtcattgccgttgtcaatttcaaaggcggttcgggaaagacgacgacggccgcccatctcgcgcagtacatggcgttgaccgggcaccgtgtcttggcggtggacctcgacccgcaggcgtcactttcgtcgcttcacggttttcagcccgaactcgacatgtcgccgtcgctctatgaggcgctcagatatgacgatcaacgccgatcgatcagtgagatcatccagcctaccaatttcccgggcctcgatatcgtgcctgcgaacctcgaacttcaggagtacgagtacgacaccccgcttgcgatgtcgaacaagagctcgaacgatggcaagaccttcttcacgcggatttcgcgcgcgctgtcggaagtcaacgaccgctatgacgttgtcgtcatcgactgccctccccagctcggctatctcacgatcaccgcgctgactgcggctacgagcgtcctgatcacgatccatccacagatgctcgacgtcatgtcgatgggccagttccttttgatgctgggcgggatcctgaagccgatccgggatgtgggtgctgcggtcaatctcgaatggtatcgctatctgatcacccggtacgagccaacggatgggccgcaggcgcagatggtgggcttcatgcagaccttgttccaccagtttgtgctgaagaaccagatgctgaaatcgacagcggtttcagacgccggaatcaccaagcagaccctttacgaagtcgacaagagtcagatgacgcggtccacctatgagcgcgcgatggactccttgaacgcagtcaacgccgagatcgtcgaactcgtccatgcctcttgggggaggaaggttgtcagttgagaagtgtaaacttccccgggacggcccggtagatctcaggcaaacggagcaggcacatggcgagaaagaacctactggcgggactggtagacacagcggaaatcccgcacgcagacgttgcgcccgcctacccgatgcgcggggcttcgaagagcatggtgcgctcgctcgacgagttgtcgcgccaggccgagaaatttctcgaaggagaaacggtcgtcgaactcgaccctgagacactcgatggttcgttcgtctctgatcgcatgggcgatagttccgagcagttcgaggaattgaagcaggcgattgccgagcgcgggcaggatacgcccatccttgtgcgcccccacccgtcggcagccgatcgttaccagatcgtctttggacaccgccgagcccgcgttgcccgcgagctcggccgcaaggttaaggcggtcgtcaaggcgctggatgaccgcacgcacgttatcgcccagggacaggaaaactcggcgcgcgccaacctctccttcattgaacgggcgaacttcgcctcgcacctcgagaagcttggctatgaccggacaatcataggatcggcgcttgctgccaatgcggccgctatctcgaaaatgatcgccgtaatagatcgtattcctgaagagacaatcgcaagaatcgggccctgcccggcggtcggccgagaacgctgggtcgagttgtcattgcttgtgggtaaaaccgccaacgaagcgaaggtgaaggcaatcgtctctgatccttccttcaatgaactgagcactgacgatcgcttcaattccctgttttctggtctgaacagcgcggcgaagcctgtccggaagacgactccaaagatcctggagaactggcaaccggcggacaagaccgtctccgctaagtattcgaactccgccaaggcgtttgccttgtctatgaaatcaaggaatgccggcccctttgggcggtatattgcagacaacctggaccggctctatgccgagttcctggagcagggtaatcggaaggaagactgacgcaaaagaaaaaggcccccagacggtaaccatcgtggaagcctctctcatcgtttagcagcctgagaatcgcatttccacgaatcgcagtcaagagtctttggcaccggaacgggtgagcggacgtcttttgcctgaggataggtgaaagaagatgcaagatggaagtgtgacgacgcccttcgggcggcggtcgatgacgcttggcatgttggcaagccaatatatgtcgcgtgaactcgaacctgaaacatcggctgacaagtggaagctgtttcgagcgctctgcgaagctaagccgaagctcggcatcagcgaacgtgcgctctctgttatgaacgcacttttgagcttttatcccgagacgaccttgtctgaggaaaacggcctcatcgtgttcccctctaacatgcagttgtcgcttcgtgcgcatggcatggctgaagcgacgttgcgtcgccacatcgcagcgctcgtcgacgctggccttctggcacgccgggatagcccaaatggcaaacgctacgcccgcaaggacggagacggttcgatcgatgaggcctatgggttttcgttggctccgttgctgtcacgcgcacgcgagatcgagcaaatagctgcctatgtcaaaattgagcgactgcaattgcgtagacttcgcgagcgcctgacgatctgccggcgcgatatcggtaagctgattgaagtcgccattgaggagggagtggacggtaattgggacggaattcaccagcactaccgcagcctagtagcgaccattcctcgagtggcaacggccgcgaccgtcgcccccatcctcgaagagatggagatgttgcgcgaggaaatctccaacctt

SEQ ID NO: 61 - DNA, 32 bp, Artificial sequence
  32 bp palindrome
cgttcctcgaggcctcgaggcctcgaggaacg

SEQ ID NO: 62 - DNA, 146 bp, Artificial sequence
  142 bp inverted repeat
gagtccacgctagatgagagctttgttgtaggtggaccagttggtgattttgaacttttgctttgccacggaacggtctgcgttgtcgggaagatgcgtgatctgatccttcaactcagcaaaagttcgatttattcaacaaagcc

SEQ ID NO: 63 - DNA, 6968 bp, Artificial sequence
  pSB1 tra-trb region
gtgtacaaccagatatttttcaccaacatccttcgtctgctcgatgagcggggcatgacgaaacatgagctgtcggagagggcaggggtttcaatttcgtttttatcagacttaaccaacggtaaggccaacccctcgttgaaggtgatggaggccattgccgacgccctggaaactcccctacctcttctcctggagtccaccgaccttgaccgcgaggcactcgcggagattgcgggtcatcctttcaagagcagcgtgccgcccggatacgaacgcatcagtgtggttttgccgtcacataaggcgtttatcgtaaagaaatggggcgacgacacccgaaaaaagctgcgtggaaggctctgacgccaagggttagggcttgcacttccttctttagccgctaaaacggccccttctctgcgggccgtcggctcgcgcatcatatcgacatcctcaacggaagccgtgccgcgaatggcatcgggcgggtgcgctttgacagttgttttctatcagaacccctacgtcgtgcggttcgattagctgtttgtcttgcaggctaaacactttcggtatatcgtttgcctgtgcgataatgttgctaatgatttgttgcgtaggggttactgaaaagtgagcgggaaagaagagtttcagaccatcaaggagcgggccaagcgcaagctggaacgcgacatgggtgcggacctgttggccgcgctcaacgacccgaaaaccgttgaagtcatgctcaacgcggacggcaaggtgtggcacgaacgccttggcgagccgatgcggtacatctgcgacatgcggcccagccagtcgcaggcgattatagaaacggtggccggattccacggcaaagaggtcacgcggcattcgcccatcctggaaggcgagttccccttggatggcagccgctttgccggccaattgccgccggtcgtggccgcgccaacctttgcgatccgcaagcgcgcggtcgccatcttcacgctggaacagtacgtcgaggcgggcatcatgacccgcgagcaatacgaggtcattaaaagcgccgtcgcggcgcatcgaaacatcctcgtcattggcggtactggctcgggcaagaccacgctcgtcaacgcgatcatcaatgaaatggtcgccttcaacccgtctgagcgcgtcgtcatcatcgaggacaccggcgaaatccagtgcgccgcagagaacgccgtccaataccacaccagcatcgacgtctcgatgacgctgctgctcaagacaacgctgcgtatgcgccccgaccgcatcctggtcggtgaggtacgtggccccgaagcccttgatctgttgatggcctggaacaccgggcatgaaggaggtgccgccaccctgcacgcaaacaaccccaaagcgggcctgagccggctcgccatgcttatcagcatgcacccggattcaccgaaacccattgagccgctgattggcgaggcggttcatgtggtcgtccatatcgccaggacccctagcggccgtcgagtgcaagaaattctcgaagttcttggttacgagaacggccagtacatcaccaaaaccctgtaaggagtatttccaatgacaacggctgttccgttccgtctgaccatgaatcgcggcattttgttctaccttgccgtgttcttcgttctcgctctcgcgttatccgcgcatccggcgatggcctcggaaggcaccggcggcagcttgccatatgagagctggctgacgaacctgcgcaactccgtaaccggcccggtggccttcgcgctgtccatcatcggcatcgtcgtcgccggcggcgtgctgatcttcggcggcgaactcaacgccttcttccgaaccctgatcttcctggttctggtgatggcgctgctggtcggcgcgcagaacgtgatgagcaccttcttcggtcgtggtgccgaaatcgcggccctcggcaacggggcgctgcaccaggtgcaagtcgcggcggcggatgccgtgcgtgcggtagcggctggacggctcgcctaatcatggctctgcgcacgatccccatccgtcgcgcaggcaaccgagaaaacctgttcatgggtggtgatcgtgaactggtgatgttctcgggcctgatggcgtttgcgctgattttcagcgcccaagagctgcgggccaccgtggtcggtctgatcctgtggttcggggcgctctatgcgttccgaatcatggcgaaggccgatccgaagatgcggttcgtgtacctgcgtcaccgccggtacaagccgtattacccggcccgctcgaccccgttccgcgagaacaccaatagccaagggaagcaataccgatgatccaagcaattgcgattgcaatcgcgggcctcggcgcgcttctgttgttcatcctctttgcccgcatccgcgcggtcgatgccgaactgaaactgaaaaagcatcgttccaaggacgccggcctggccgatctgctcaactacgccgctgtcgtcgatgacggcgtaatcgtgggcaagaacggcagctttatggctgcctggctgtacaagggcgatgacaacgcaagcagcaccgaccagcagcgcgaagtagtgtccgcccgcatcaaccaggccctcgcgggcctgggaagtgggtggatgatccatgtggacgccgtgcggcgtcctgctccgaactacgcggagcggggcctgtcggcgttccctgaccgtctgacggcagcgattgaagaagagcgctcggtcttgccttgctcgtcggtgatgtacttcaccagctccgcgaagtcgctcttcttgatggagcgcatggggacgtgcttggcaatcacgcgcaccccccggccgttttagcggctaaaaaagtcatggctctgccctcgggcggaccacgcccatcatgaccttgccaagctcgtcctgcttctcttcgatcttcgccagcagggcgaggatcgtggcatcaccgaaccgcgccgtgcgcgggtcgtcggtgagccagagtttcagcaggccgcccaggcggcccaggtcgccattgatgcgggccagctcgcggacgtgctcatagtccacgacgcccgtgattttgtagccctggccgacggccagcaggtaggccgacaggctcatgccggccgccgccgccttttcctcaatcgctcttcgttcgtctggaaggcagtacaccttgataggtgggctgcccttcctggttggcttggtttcatcagccatccgcttgccctcatctgttacgccggcggtagccggccagcctcgcagagcaggattcccgttgagcaccgccaggtgcgaataagggacagtgaagaaggaacacccgctcgcgggtgggcctacttcacctatcctgcccggctgacgccgttggatacaccaaggaaagtctacacgaaccctttggcaaaatcctgtatatcgtgcgaaaaaggatggatataccgaaaaaatcgctataatgaccccgaagcagggttatgcagcggaaaagcgctgcttccctgctgttttgtggaatatctaccgactggaaacaggcaaatgcaggaaattactgaactgaggggacaggcgagagacgatgccaaagagctacaccgacgagctggccgagtgggttgaatcccgcgcggccaagaagcgccggcgtgatgaggctgcggttgcgttcctggcggtgagggcggatgtcgaggcggcgttagcgtccggctatgcgctcgtcaccatttgggagcacatgcgggaaacggggaaggtcaagttctcctacgagacgttccgctcgcacgccaggcggcacatcaaggccaagcccgccgatgtgcccgcaccgcaggccaaggctgcggaacccgcgccggcacccaagacgccggagccacggcggccgaagcaggggggcaaggctgaaaagccggcccccgctgcggccccgaccggcttcaccttcaacccaacaccggacaaaaaggatctactgtaatggcgaaaattcacatggttttgcagggcaagggcggggtcggcaagtcggccatcgccgcgatcattgcgcagtacaagatggacaaggggcagacacccttgtgcatcgacaccgacccggtgaacgcgacgttcgagggctacaaggccctgaacgtccgccggctgaacatcatggccggcgacgaaattaactcgcgcaacttcgacaccctggtcgagctgattgcgccgaccaaggatgacgtggtgatcgacaacggtgccagctcgttcgtgcctctgtcgcattacctcatcagcaaccaggtgccggctctgctgcaagaaatggggcatgagctggtcatccataccgtcgtcaccggcggccaggctctcctggacacggtgagcggcttcgcccagctcgccagccagttcccggccgaagcgcttttcgtggtctggctgaacccgtattgggggcctatcgagcatgagggcaagagctttgagcagatgaaggcgtacacggccaacaaggcccgcgtgtcgtccatcatccagattccggccctcaaggaagaaacctacggccgcgatttcagcgacatgctgcaagagcggctgacgttcgaccaggcgctggccgatgaatcgctcacgatcatgacgcggcaacgcctcaagatcgtgcggcgcggcctgtttgaacagctcgacgcggcggccgtgctatgagcgaccagattgaagagctgatccgggagattgcggccaagcacggcatcgccgtcggccgcgacgacccggtgctgatcctgcataccatcaacgcccggctcatggccgacagtgcggccaagcaagaggaaatccttgccgcgttcaaggaagagctggaagggatcgcccatcgttggggcgaggacgccaaggccaaagcggagcggatgctgaacgcggccctggcggccagcaaggacgcaatggcgaaggtaatgaaggacagcgccgcgcaggcggccgaagcgatccgcagggaaatcgacgacggccttggccgccagctcgcggccaaggtcgcggacgcgcggcgcgtggcgatgatgaacatgatcgccggcggcatggtgttgttcgcggccgccctggtggtgtgggcctcgttatgaatcgcagaggcgcagatgaaaaagcccggcgttgccgggctttgtttttgcgttagctgggcttgtttgacaggcccaagctctgactgcgcccgcgctcgcgctcctgggcctgtttcttctcctgctcctgcttgcgcatcagggcctggtgccgtcgggctgcttcacgcatcgaatcccagtcgccggccagctcgggatgctccgcgcgcatcttgcgcgtcgccagttcctcgatcttgggcgcgtgaatgcccatgccttccttgatttcgcgcaccatgtccagccgcgtgtgcagggtctgcaagcgggcttgctgttgggcctgctgctgctgccaggcggcctttgtacgcggcagggacagcaagccgggggcattggactgtagctgctgcaaacgcgcctgctgacggtctacgagctgttctaggcggtcctcgatgcgctccacctggtcatgctttgcctgcacgtagagcgcaagggtctgctggtaggtctgctcgatgggcgcggattctaagagggcctgctgttccgtctcggcctcctgggccgcctgtagcaaatcctcgccgctgttgccgctggactgctttactgccggggactgctgttgccctgctcgcgccgtcgtcgcagttcggcttgcccccactcgattgactgcttcatttcgagccgcagcgatgcgatctcggattgcgtcaacggacggggcagcgcggaggtgtccggcttctccttgggtgagtcggtcgatgccatagccaaaggtttccttccaaaatgcgtccattgctggaccgtgtttctcattgatgcccgcaagcatcttcggcttgaccgccaggtcaagcgcgccttcatgggcggtcatgacggacgccgccatgaccttgccgccgttgttctcgatgtagccgcgtaatgaggcaatggtgccgcccatcgtcagcgtgtcatcgacaacgatgtacttctggccggggatcacctccccctcgaaagtcgggttgaacgccaggcgatgatctgaaccggctccggttcgggcgaccttctcccgctgcacaatgtccgtttcgacctcaaggccaaggcggtcggccagaacgaccgccatcatggccggaatcttgttgttccccgccgcctcgacggcgaggactggaacgatgcggggcttgtcgtcgccgatcagcgtcttgagctgggcaacagtgtcgtccgaaatcaggcgctcgaccaaattaagcgccgcttccgcgtcgccctgcttcgcagcctggtattcaggctcgttggtcaaagaaccaaggtcgccgttgcgaaccaccttcgggaagtctccccacggtgcgcgctcggctctgctgtagctgctcaagacgcctccctttttagccgctaaaactctaacgagtgcgcccgcgactcaacttgacgctttcggcacttacctgtgccttgccacttgcgtcataggtgatgcttttcgcactcccgatttcaggtactttatcgaaatctgaccgggcgtgcattacaaagttcttccccacctgttggtaaatgctgccgctatctgcgtggacgatgctgccgtcgtggcgctgcgacttatcggccttttgggccatatagatgttgtaaatgccaggtttcagggccccggctttatctaccttctggttcgtccatgcgccttggttctcggtctggacaattctttgcccattcatgaccaggaggcggtgtttcat

SEQ ID NO: 64 - DNA, 1660 bp, Escherichia coli
gtggcgcaacgatgccggcgacaagcaggagcgcaccgacttcttccgcatcaagtgttttggctctcaggccgaggcccacggcaagtatttgggcaaggggtcgctggtattcgtgcagggcaagattcggaataccaagtacgagaaggacggccagacggtctacgggaccgacttcattgccgataaggtggattatctggacaccaaggcaccaggcgggtcaaatcaggaataagggcacattgccccggcgtgagtcggggcaatcccgcaaggagggtgaatgaatcggacgtttgaccggaaggcatacaggcaagaactgatcgacgcggggttttccgccgaggatgccgaaaccatcgcaagccgcaccgtcatgcgtgcgccccgcgaaaccttccagtccgtcggctcgatggtccagcaagctacggccaagatcgagcgcgacagcgtgcaactggctccccctgccctgcccgcgccatcggccgccgtggagcgttcgcgtcgtctcgaacaggaggcggcaggtttggcgaagtcgatgaccatcgacacgcgaggaactatgacgaccaagaagcgaaaaaccgccggcgaggacctggcaaaacaggtcagcgaggccaagcaggccgcgttgctgaaacacacgaagcagcagatcaaggaaatgcagctttccttgttcgatattgcgccgtggccggacacgatgcgagcgatgccaaacgacacggcccgctctgccctgttcaccacgcgcaacaagaaaatcccgcgcgaggcgctgcaaaacaaggtcattttccacgtcaacaaggacgtgaagatcacctacaccggcgtcgagctgcgggccgacgatgacgaactggtgtggcagcaggtgttggagtacgcgaagcgcacccctatcggcgagccgatcaccttcacgttctacgagctttgccaggacctgggctggtcgatcaatggccggtattacacgaaggccgaggaatgcctgtcgcgcctacaggcgacggcgatgggcttcacgtccgaccgcgttgggcacctggaatcggtgtcgctgctgcaccgcttccgcgtcctggaccgtggcaagaaaacgtcccgttgccaggtcctgatcgacgaggaaatcgtcgtgctgtttgctggcgaccactacacgaaattcatatgggagaagtaccgcaagctgtcgccgacggcccgacggatgttcgactatttcagctcgcaccgggagccgtacccgctcaagctggaaaccttccgcctcatgtgcggatcggattccacccgcgtgaagaagtggcgcgagcaggtcggcgaagcctgcgaagagttgcgaggcagcggcctggtggaacacgcctgggtcaatgatgacctggtgcattgcaaacgctagggccttgtggggtcagttccggctgggggttcagcagccagcgctttactggcatttcaggaacaagcgggcactgctcgacgcacttgcttcgctcagtatcgctcgggacgcacggcgcgctctacgaactgccgataaacagaggattaaaattgacaattgtgattaaggctcagattcgacggcttggagcggccgacgtgcaggatttccgcgaga

SEQ ID NO: 65 - DNA, 868 bp, Escherichia coli
agaacacgagcacggcacccgcgaccactatgccaagaatgcccaaggtaaaaattgccggccccgccatgaagtccgtgaatgccccgacggccgaagtgaagggcaggccgccacccaggccgccgccctcactgcccggcacctggtcgctgaatgtcgatgccagcacctgcggcacgtcaatgcttccgggcgtcgcgctcgggctgatcgcccatcccgttactgccccgatcccggcaatggcaaggactgccagcgctgccatttttggggtgaggccgttcgcggccgaggggcgcagcccctggggggatgggaggcccgcgttagcgggccgggagggttcgagaagggggggcaccccccttcggcgtgcgcggtcacgcgcacagggcgcagccctggttaaaaacaaggtttataaatattggtttaaaagcaggttaaaagacaggttagcggtggccgaaaaacgggcggaaacccttgcaaatgctggattttctgcctgtggacagcccctcaaatgtcaataggtgcgcccctcatctgtcagcactctgcccctcaagtgtcaaggatcgcgcccctcatctgtcagtagtcgcgcccctcaagtgtcaataccgcagggcacttatccccaggcttgtccacatcatctgtgggaaactcgcgtaaaatcaggcgttttcgccgatttgcgaggctggccagctccacgtcgccggccgaaatcgagcctgcccctcatctgtcaacgccgcgccgggtgagtcggcccctcaagtgtcaacgtccgcccctcatctgtcagtgagggccaagttttccgcgaggtatccacaacgccggcggccgc

SEQ ID NO: 66 - DNA, 3129 bp, Escherichia coli
cgctcaccgggctggttgccctcgccgctgggctggcggccgtctatggccctgcaaacgcgccagaaacgccgtcgaagccgtgtgcgagacaccgcggccgccggcgttgtggatacctcgcggaaaacttggccctcactgacagatgaggggcggacgttgacacttgaggggccgactcacccggcgcggcgttgacagatgaggggcaggctcgatttcggccggcgacgtggagctggccagcctcgcaaatcggcgaaaacgcctgattttacgcgagtttcccacagatgatgtggacaagcctggggataagtgccctgcggtattgacacttgaggggcgcgactactgacagatgaggggcgcgatccttgacacttgaggggcagagtgctgacagatgaggggcgcacctattgacatttgaggggctgtccacaggcagaaaatccagcatttgcaagggtttccgcccgtttttcggccaccgctaacctgtcttttaacctgcttttaaaccaatatttataaaccttgtttttaaccagggctgcgccctgtgcgcgtgaccgcgcacgccgaaggggggtgcccccccttctcgaaccctcccggcccgctctcgagttggcagcatcacccataattgtggtttcaaaatcggctccgtcgatactatgttatacgccaactttgaaaacaactttgaaaaagctgttttctggtatttaaggttttagaatgcaaggaacagtgaattggagttcgtcttgttataattagcttcttggggtatctttaaatactgtagaaaagaggaaggaaataataaatggctaaaatgagaatatcaccggaattgaaaaaactgatcgaaaaataccgctgcgtaaaagatacggaaggaatgtctcctgctaaggtatataagctggtgggagaaaatgaaaacctatatttaaaaatgacggacagccggtataaagggaccacctatgatgtggaacgggaaaaggacatgatgctatggctggaaggaaagctgcctgttccaaaggtcctgcactttgaacggcatgatggctggagcaatctgctcatgagtgaggccgatggcgtcctttgctcggaagagtatgaagatgaacaaagccctgaaaagattatcgagctgtatgcggagtgcatcaggctctttcactccatcgacatatcggattgtccctatacgaatagcttagacagccgcttagccgaattggattacttactgaataacgatctggccgatgtggattgcgaaaactgggaagaagacactccatttaaagatccgcgcgagctgtatgattttttaaagacggaaaagcccgaagaggaacttgtcttttcccacggcgacctgggagacagcaacatctttgtgaaagatggcaaagtaagtggctttattgatcttgggagaagcggcagggcggacaagtggtatgacattgccttctgcgtccggtcgatcagggaggatatcggggaagaacagtatgtcgagctattttttgacttactggggatcaagcctgattgggagaaaataaaatattatattttactggatgaattgttttagtacctagatgtggcgcaacgatgccggcgacaagcaggagcgcaccgacttcttccgcatcaagtgttttggctctcaggccgaggcccacggcaagtatttgggcaaggggtcgctggtattcgtgcagggcaagattcggaataccaagtacgagaaggacggccagacggtctacgggaccgacttcattgccgataaggtggattatctggacaccaaggcaccaggcgggtcaaatcaggaataagggcacattgccccggcgtgagtcggggcaatcccgcaaggagggtgaatgaatcggacgtttgaccggaaggcatacaggcaagaactgatcgacgcggggttttccgccgaggatgccgaaaccatcgcaagccgcaccgtcatgcgtgcgccccgcgaaaccttccagtccgtcggctcgatggtccagcaagctacggccaagatcgagcgcgacagcgtgcaactggctccccctgccctgcccgcgccatcggccgccgtggagcgttcgcgtcgtctcgaacaggaggcggcaggtttggcgaagtcgatgaccatcgacacgcgaggaactatgacgaccaagaagcgaaaaaccgccggcgaggacctggcaaaacaggtcagcgaggccaagcaggccgcgttgctgaaacacacgaagcagcagatcaaggaaatgcagctttccttgttcgatattgcgccgtggccggacacgatgcgagcgatgccaaacgacacggcccgctctgccctgttcaccacgcgcaacaagaaaatcccgcgcgaggcgctgcaaaacaaggtcattttccacgtcaacaaggacgtgaagatcacctacaccggcgtcgagctgcgggccgacgatgacgaactggtgtggcagcaggtgttggagtacgcgaagcgcacccctatcggcgagccgatcaccttcacgttctacgagctttgccaggacctgggctggtcgatcaatggccggtattacacgaaggccgaggaatgcctgtcgcgcctacaggcgacggcgatgggcttcacgtccgaccgcgttgggcacctggaatcggtgtcgctgctgcaccgcttccgcgtcctggaccgtggcaagaaaacgtcccgttgccaggtcctgatcgacgaggaaatcgtcgtgctgtttgctggcgaccactacacgaaattcatatgggagaagtaccgcaagctgtcgccgacggcccgacggatgttcgactatttcagctcgcaccgggagccgtacccgctcaagctggaaaccttccgcctcatgtgcggatcggattccacccgcgtgaagaagtggcgcgagcaggtcggcgaagcctgcgaagagttgcgaggcagcggcctggtggaacacgcctgggtcaatgatgacctggtgcattgcaaacgctagggccttgtggggtcagttccggctgggggttcagccagcgctttac

SEQ ID NO: 67 - DNA, 1026 bp, Escherichia coli
atgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatag

SEQ ID NO: 68 - DNA, 4148 bp, Artificial sequence
  linker
gtttacccgccaatatatcctgtcaaacactgatagtttaaactgaaggcgggaaacgacaatctgatcatgagcggagaattaagggagtcacgttatgacccccgccgatgacgcgggacaagccgttttacgtttggaactgacagaaccgcaacgttgaaggagccactcagcaagctggtacgattgtaatacgactcactatagggcgaattgagcgctgtttaaacgctcttcaactggaagagcggttaccagagctggtcacctttgtccaccaagatggaactgcggcctcgagatccactagagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactttaacttagcctaggatccacacgacaccatgtcccccgagcgccgccccgtcgagatccgcccggccaccgccgccgacatggccgccgtgtgcgacatcgtgaaccactacatcgagacctccaccgtgaacttccgcaccgagccgcagaccccgcaggagtggatcgacgacctggagcgcctccaggaccgctacccgtggctcgtggccgaggtggagggcgtggtggccggcatcgcctacgccggcccgtggaaggcccgcaacgcctacgactggaccgtggagtccaccgtgtacgtgtcccaccgccaccagcgcctcggcctcggctccaccctctacacccacctcctcaagagcatggaggcccagggcttcaagtccgtggtggccgtgatcggcctcccgaacgacccgtccgtgcgcctccacgaggccctcggctacaccgcccgcggcaccctccgcgccgccggctacaagcacggcggctggcacgacgtcggcttctggcagcgcgacttcgagctgccggccccgccgcgcccggtgcgcccggtgacgcagatctccggtggaggcggcagcggtggcggaggctccggaggcggtggctccatggcctcctccgaggacgtcatcaaggagttcatgcgcttcaaggtgcgcatggagggctccgtgaacggccacgagttcgagatcgagggcgagggcgagggccgcccctacgagggcacccagaccgccaagctgaaggtgaccaagggcggccccctgcccttcgcctgggacatcctgtccccccagttccagtacggctccaaggtgtacgtgaagcaccccgccgacatccccgactacaagaagctgtccttccccgagggcttcaagtgggagcgcgtgatgaacttcgaggacggcggcgtggtgaccgtgacccaggactcctccctgcaggacggctccttcatctacaaggtgaagttcatcggcgtgaacttcccctccgacggccccgtaatgcagaagaagactatgggctgggaggcctccaccgagcgcctgtacccccgcgacggcgtgctgaagggcgagatccacaaggccctgaagctgaaggacggcggccactacctggtggagttcaagtccatctacatggccaagaagcccgtgcagctgcccggctactactacgtggactccaagctggacatcacctcccacaacgaggactacaccatcgtggagcagtacgagcgcgccgagggccgccaccacctgttcctgtagtcaggatctgagtcgaaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgccaccgcggtggagctcgaattcattccgattaatcgtggcctcttgctcttcaggatgaagagctatgtttaaacgtgcaagcgctactagacaattcagtacattaaaaacgtccgcaatgtgttattaagttgtctaagcgtcaatttgtttacaccacaatatatcctgccac

SEQ ID NO: 69 - DNA, 18762 bp, Artificial sequence
  synthetic consruct
gtttacccgccaatatatcctgtcaaacactgatagtttaaactgaaggcgggaaacgacaatctgatcatgagcggagaattaagggagtcacgttatgacccccgccgatgacgcgggacaagccgttttacgtttggaactgacagaaccgcaacgttgaaggagccactcagcaagctggtacgattgtaatacgactcactatagggcgaattgagcgctgtttaaacgctcttcaactggaagagcggttacgctgtttaaacgctcttcaactggaagagcggttactaccggttcactagctagctgctaaggttaccagagctggtcacctttgtccaccaacttattaagtatctagttgaagacacgttcttcttcacgtaagaagacactcagtagtcttcggccagaatggcctcttgattcagcgggcctagaaggccggatcactgactagctaatttaaatcctgaggatctggtcttcctaaggacccgggatatcggaccgattaaactttaattcggtccgataacttcgtatagcatacattatacgaagttatatgcatacgcgtcttaagtcgatcgctatcaactttgtatagaaaagttgggccgagctcggtacggccagaatggcccggaccgggttaccgaattcaggcgacccatcgctgctttgtctacatcatgttcttcatcatcctccccaggcgacgcgtgctgctgttcttattcagactaccgttcgagtgactgcatggcgtacatctttctgcatcgactttgtacggctacatcgaacatatacacgagatgtctcgtgtgaatagagtcactaatgccttaagcatcggttactccgtagggtacattctgttcttcttatttgtgcatatttttattgttgtttactgattatacgagtagttatacatacatgcacatacatatcatcacatatatcacaatatttttctaaattaaattaaaactaaaaatgactaaatttctaacaccaacgacattgtaatgttttctccaacaactttacctattctacattgttctatttcgaatttcactctataaacaacatagtctacaatggaaaacagtgctttgtacgactatatacgcgatgtgtggctacaacataagacaatatagtcgtttgaagattgaacctatatatcggtacggttaatccgtctatgtacgtgggcatgacgaacacccgtgataacgaaggattaacgtgcacaatcataaatccaaagtaggagcggtgcatgatgagaatcgctctcagtactcgacataatgaaccttacgaggtacaacaggcaggcaggcagggaccaggggccgcctttatttcaggctcgctggccccacgggcgtgctgcgtgcacgaagggcactaccccaacctctcaccgaaaaccgcgctggatcggcaaatcaaacgaggtggtgccccgtgcccactctccacgtccacggcaccatccctctgcagccgctcaccagccatgccgtgtcgcggaacggcacaaccacccccaacccactcacgaaaccccgtcccggccgtgcccgtgtcggtccgcgctcggcaacgaggcggcccgcgctgctgagtcccctggacacccgacaccctgtcggccctttgtttattcatcccgaaatctcatctgcccccacggccgactgcgctgcgccgcccggatatatatacccatcgttatcgatcgactggggactctatcagtgatagagtctagaggatcgctcaggaaggccgctgagatagaggcatggcggccaatgcgggcggcggtggagcgggaggaggcagcggcagcggcagcgtggctgcgccggcggtgtgccgccccagcggctcgcggtggacgccgacgccggagcagatcaggatgctgaaggagctctactacggctgcggcatccggtcgcccagctcggagcagatccagcgcatcaccgccatgctgcggcagcacggcaagatcgagggcaagaacgtcttctactggttccagaaccacaaggcccgcgagcgccagaagcgccgcctcaccagcctcgacgtcaacgtgcccgccgccggcgcggccgacgccaccaccagccaactcggcgtcctctcgctgtcgtcgccgccgccttcaggcgcggcgcctccctcgcccaccctcggcttctacgccgccggcaatggcggcggatcggctgtgctgctggacacgagttccgactggggcagcagcggcgctgccatggccaccgagacatgcttcctgcaggactacatgggcgtgacggacacgggcagctcgtcgcagtggccacgcttctcgtcgtcggacacgataatggcggcggccgcggcgcgggcggcgacgacgcgggcgcccgagacgctccctctcttcccgacctgcggcgacgacggcggcagcggtagcagcagctacttgccgttctggggtgccgcgtccacaactgccggcgccacttcttccgttgcgatccagcagcaacaccagctgcaggagcagtacagcttttacagcaacagcaacagcacccagctggccggcaccggcaaccaagacgtatcggcaacagcagcagcagccgccgccctggagctgagcctcagctcatggtgctccccttaccctgctgcagggagtatgtgagagcaacgcgagctgccactgctcttcactggtaccgttaacagatcattcgacaaagcagcattagtccgttgatcggtggaagaccactcgtcagtgttgagttgaatgtttgatcaataaaatacggcaatgctgtaagggttgttttttatgccattgataatacactgtactgttcagttgttgaactctatttcttagccatgccaagtgcttttcttattttgaataacattacagcaaaaagttgaaagacaaaaaaaaaaacccccgaacagagtgctttgggtcccaagcttctttagactgtgttcggcgttccccctaaatttctccccctatatctcactcacttgtcacatcagcgttctctttccccctatatctccacgctctacagcagttccacctatatcaaacctctataccccaccacaacaatattatatactttcatcttcaactaactcatgtaccttccaatttttttctactaataattatttacgtgcacagaaacttagcaaggagagagagagcggggtgacccaccttgctagttggatattacctcttctcttcaaagtatccttgaacgctcaccggttatcaaatctctacactatagctctgtagtcttgctagatagttagttctttagctctcggtgaccaagcttggcgcgatcaagcttatcgataccgtcgacctcgaagcttggtcacccggtccgggcctagaaggccagcttcaagtttgtacaaaaaagcaggctccggccagaatggcccggaccgggttaccgaattcttaccctagctccctgcggctgttacgcggtcccccatcaatcttctgttcttgcggttgtagcctgtgtaacagtgctagagtatgtatgataaataggttttaagtctgcttacatgacattttttattgtggaagagacatataaaaattagagagagtggttctcatgcaacggcggacggcccggtgctaaaagagcttcaagacaaaataatgaaacaggaagagagtagatttatctaagagccaactttattatatgaatgtgtttattgttggctttagatgatatggtaaggagttagagctaataatagataggctctattattattattattaattaaactcgctctaaggaggaaagtgggaggaagggacgaggacgaagactactggaagcatcgtgcatggatgatggatgtggtgtctcttaatgtaggtggccggaggatgtacgtgttaattgcgcgataagcactcagatccaaccgcaaactacctccacactgacacactgatagagagaaagagagacctccgacgactgccgccgcagatgagccacgtacgtatacgacgtctgccggccggctcaggctgccgccatcaccctgctcgaaagtcgcgttaggcggcgccagctacataggagtatctagtctagccagttagtatactactactgcgctgatgatgaattaactctgcatagatactgtacttgcctccctccaacacccaaccacctcctgctcggctcttaataacttggacacggatcgatgccatccaaggaagaacacgacgacgacgacggaacatccaccatgcaagcttgcatccatacgccgatacgcgtgcatccatccatccaccattatttccattttccaccgatcacacgtacacaggcctatttaaggagcgacatcccactgcaactctcctcaccactcatcaccagctagctctagcaaagcacttgccatctaccgaccgccgcattccaaacagcccgacgagctagcagagcggcaggcacctccctcctcaaggaacccatggccactgtgaacaactggctcgctttctccctctccccgcaggagctgccgccctcccagacgacggactccacactcatctcggccgccaccgccgaccatgtctccggcgatgtctgcttcaacatcccccaagattggagcatgaggggatcagagctttcggcgctcgtcgcggagccgaagctggaggacttcctcggcggcatctccttctccgagcagcatcacaaggccaactgcaacatgatacccagcactagcagcacagtttgctacgcgagctcaggtgctagcaccggctaccatcaccagctgtaccaccagcccaccagctcagcgctccacttcgcggactccgtaatggtggcttcctcggccggtgtccacgacggcggtgccatgctcagcgcggccgccgctaacggtgtcgctggcgctgccagtgccaacggcggcggcatcgggctgtccatgattaagaactggctgcggagccaaccggcgcccatgcagccgagggtggcggcggctgagggcgcgcaggggctctctttgtccatgaacatggcggggacgacccaaggcgctgctggcatgccacttctcgctggagagcgcgcacgggcgcccgagagtgtatcgacgtcagcacagggtggagccgtcgtcgtcacggcgccgaaggaggatagcggtggcagcggtgttgccggcgctctagtagccgtgagcacggacacgggtggcagcggcggcgcgtcggctgacaacacggcaaggaagacggtggacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggaaggatgtctgcatgggggactgtcgtgtctgcagccgcggcggcagcagcaagcagcaacgacaacatggccgccgacgtcgggcatggcggcgcgcagctcttcagtgtctggaacgacacttaagcgtacctagtggtacctgacatcttatagtctgcaacctctcgtgtctgaattcctatctttatcaagtgttattgcttccacgactataggacagctttcgtcgaaagcttttgctcatgtgatctcgaaggattcatctagtctgatttttcgtgacttgtatcggttttattggattcatccaacatatatcaataaaaaatgagttgtgtttcctttcttcctagttcagttaaaattatttccctcctgcgcttgtgctgtaattgtctgtgtacctgttgtttgtgactgtgttagttcccttggatatgatttcgtatttgatatgtacatggagatagcttagcttcattattggagtatgaagttagtatgacatagtcactctcctggaaaattgacactgcaaaccatatttttattctgaaccacaaatcctagtcagtccgctggcatatgccgtccgtttgctgaatccagaacgtgggtttggagatgtacggctgagatgcctctatgcgaaggggatttcgtggtgaaacgagatgggagtagagcaacgcccgtggaagatgcttcaaacttccacacttttgagcaacgatcggcagtagtaaggtagacgatttcaagatcaaagcatatgaagataaacaacatcaacaacaaaatttgttggggttctatagagagaaacagagctacatacatacactgttttgtatctaccatctgagatgatgaaaagatgaaaaactaaagaatgccccggcgccaacgccaggacacgccgcgcgcgcgtcacccgagccatctcttgacccagccggcgctgtatatttacacacgttgcagcatcgatcaccacctgttcgatcgcgtcgccgtcaccgggatctgagtcgaaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcgaccttcttatgtgcttctagtctccaaatgtggttgatagttattttgctctaagatcaacagtaatgaagtataaatcatcgttgtggtgtgctactcggttaattgagcattaacacacacaaacatgacgaggatggtataatctccaaaaatgtgtactttgttaggtgggaccctatagccttgattaatgtgctatgttaggcatgcctggaaacgtgtgacgcatatgttttgtgaacctgttgatattatatgtgcttttatattaccatattttattaaaatactaatatttattactagtaagatataacattctatctagcttaaaaactaaccataaatattccataataactagatttaccaaactaatatactaaatatacataataaatacaaaattaacaagacaataatcaatatttatgagcttaatatatttagacattatggttggtcgacgataatcatgctaacttttcgtaattgcttgattgaaatatgcttagaataatgcctctttgttctacatggcaaatagggaccattatggtgtaacaccctgggaaccacaaacaccccgaaatgctactaaactacacaactaaccttcatatataaaatttcgacagcatctcctttgaaaatttgcatagacgtggaagcaacagagtataaacagatatcatgataagaaaacatactagacattaataatctgctagaaatgggaagaatcctaacttgacgactgcgtaactgactagagtcacacttagctgaccctagtcacttacaactgacttcgtgtcctagatcgatgggccctggccgaagcttggtcacccggtccgggcctagaaggccagcttcaagtttgtacaaaaaagcaggctccggccagaatggcccggaccgggttaccgaattcgagctcggtaccctgggatccgattgactatctcattcctcaaaccaaacacctcaaatatatctgctatcgggattggcattcctgtatccctacgcccgtgtaccccctgtttagagaacctccaaaggtataagatggcgaagattattgttgtcttgtctttcatcatatatcgagtctttccctaggatattattattggcaatgagcattacacggttaatcgattgagagaacatgcatctcaccttcagcaaataattacgataatccatattttacgcttcgtaacttctcatgagtttcgatatacaaatttgttttctggacaccctaccattcatcctcttcggagaagagaggaagtgtcctcaatttaaatatgttgtcatgctgtagttcttcacaaaatctcaacaggtaccaagcacattgtttccacaaattatattttagtcacaataaatctatattattattaatatactaaaactatactgacgctcagatgcttttactagttcttgctagtatgtgatgtaggtctacgtggaccagaaaatagtgagacacggaagacaaaagaagtaaaagaggcccggactacggcccacatgagattcggccccgccacctccggcaaccagcggccgatccaacggcagtgcgcgcacacacacaacctcgtatatatcgccgcgcggaagcggcgcgaccgaggaagccttgtcctcgacaccccctacacaggtgtcgcgctgcccccgacacgagtcccgcatgcgtcccacgcggccgcgccagatcccgcctccgcgcgttgccacgccctctataaacacccagctctccctcgccctcatctacctcactcgtagtcgtagctcaagcatcagcggcagcggcagcggcaggagctctgggcagcgtgcgcacgtggggtacctagctcgctctgctagcctaccttaagatatcggatccatgtccaacctgctcacggttcaccagaaccttccggctcttccagtggacgcgacgtccgatgaagtcaggaagaacctcatggacatgttccgcgacaggcaagcgttcagcgagcacacctggaagatgctgctctccgtctgccgctcctgggctgcatggtgcaagctgaacaacaggaagtggttccccgctgagcccgaggacgtgagggattaccttctgtacctgcaagcgcgaggtttgtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgcctaggtctggcagtgaagaccatccagcaacaccttggacaactgaacatgcttcacaggcgctccggcctcccgcgccccagcgactcgaacgccgtgagcctcgtcatgcgccgcatcaggaaggaaaacgtcgatgccggcgaaagggcaaagcaggccctcgcgttcgagaggaccgatttcgaccaggtccgcagcctgatggagaacagcgacaggtgccaggacattaggaacctggcgttcctcggaattgcatacaacacgctcctcaggatcgcggaaattgcccgcattcgcgtgaaggacattagccgcaccgacggcggcaggatgcttatccacattggcaggaccaagacgctcgtttccaccgcaggcgtcgaaaaggccctcagcctcggagtgaccaagctcgtcgaacgctggatctccgtgtccggcgtcgcggacgacccaaacaactacctcttctgccgcgtccgcaagaacggggtggctgcccctagcgccaccagccaactcagcacgagggccttggaaggtattttcgaggccacccaccgcctgatctacggcgcgaaggatgacagcggtcaacgctacctcgcatggtccgggcactccgcccgcgttggagctgctagggacatggcccgcgccggtgtttccatccccgaaatcatgcaggcgggtggatggacgaacgtgaacattgtcatgaactacattcgcaaccttgacagcgagacgggcgcaatggttcgcctcctggaagatggtgactgaggtacccaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgatccgatatcgatgggccctggccgaagcttggtcacccggtccgggcctagaaggccgatctcccgggcacccagctttcttgtacaaagtggccgttaacggatcggccagaatggcccggaccgggttaccgaattcctgcccttaaggccaattgttcaagattcattcaacaattgaaacatctcccatgattaaatcagtataaggttgctatggtcttgcttgacaaagtttttttttgagggaatttcaactaaatttttgagtgaaactatcaaatactgattttaaaaaatttttataaaaggaagcgcagagataaaaggccatctatgctacaaaagtacccaaaaatgtaatcctaaagtatgaattgcattttttttttgtttggacgaaaggaaaggagtattaccacaagaatgatatcatcttcatatttagatcttttttgggtaaagcttgagattctctaaatatagagaaatcagaagaaaaaaaaaccgtgttttggtggttttgatttctagcctccacaataactttgacggcgtcgacaagtctaacggacaccaagcagcgaaccaccagcgccgagccaagcgaagcagacggccgagacgttgacaccttcggcgcggcatctctcgagagttccgctccggcgctccacctccaccgctggcggtttcttattccgttccgttccgcctcctgctctgctcctctccacaccacacggcacgaaaccgttacggcaccggcagcacccagcacgggagaggggattcctttcccaccgttccttccctttccgccccgccgctataaatagccagccccatccccagcttttttccccaatctcatctcctctctcctgttgttcggagcacacgcacaatccgatcgatccccaaatccccttcgtctctcctcgcgagcctcgtggatcccagcttcaaggtacggcgatcgatcatcccccctccttctctctaccttcttttctctagactacatcggatggcgatccatggttagggcctgctagtttcccttcctgttttgtcgatggctgcgaggcacaatagatctgatggcgttatgacggctaacttgtcatgttgttgcgatttatagtccctttaggagatcagtttaatttctcggatggttcgagatcggtggtccatggttagtaccctaagatccgcgctgttagggttcgtagatggaggcgacctgttctgattgttaacttgtcagtacctgggaaatcctgggatggttctagctcgtccgcagatgagatcgatttcatgatcctctgtatcttgtttcgttgcctaggttccgtctaatctatccgtggtatgatgtagatgttttgatcgtgctaactacgtcttgtaaagttaattgtcaggtcataatttttagcatgcctttttttttgtttggttttgtctaattgggctgtcgttctagatcagagtagaagactgttccaaactacctgctggatttattgaacttggatctgtatgtgtgtcacatatcttcataaattcatgattaagatggattgaaatatcttttatctttttggtatggatagttctatatgttggtgtggctttgttagatgtatacatgcttagatacatgaagcaacgtgctgctactgtttagtaattgctgttcatttgtctaataaacagataaggatatgtatttatgttgctgttggttttgctggtactttgttggatacaaatgcttcaatacagaaaacagcatgctgctacgatttaccatttatctaatcttatcatatgtctaatctaataaacaaacatgcttttaaattatcttcatatgcttggatgatggcatacacagcggctatgtgtggttttttaaatacccagcatcatgggcatgcatgacactgctttaatatgctttttatttgcttgagactgtttcttttgtttatactgaccctttagttcggtgactcttctgcaggtcgactttaacttagcctaggatccatggcccagtccaagcacggcctgaccaaggagatgaccatgaagtaccgcatggagggctgcgtggacggccacaagttcgtgatcaccggcgagggcatcggctaccccttcaagggcaagcaggccatcaacctgtgcgtggtggagggcggccccttgcccttcgccgaggacatcttgtccgccgccttcatgtacggcaaccgcgtgttcaccgagtacccccaggacatcgtcgactacttcaagaactcctgccccgccggctacacctgggaccgctccttcctgttcgaggacggcgccgtgtgcatctgcaacgccgacatcaccgtgagcgtggaggagaactgcatgtaccacgagtccaagttctacggcgtgaacttccccgccgacggccccgtgatgaagaagatgaccgacaactgggagccctcctgcgagaagatcatccccgtgcccaagcagggcatcttgaagggcgacgtgagcatgtacctgctgctgaaggacggtggccgcttgcgctgccagttcgacaccgtgtacaaggccaagtccgtgccccgcaagatgcccgactggcacttcatccagcacaagctgacccgcgaggaccgcagcgacgccaagaaccagaagtggcacctgaccgagcacgccatcgcctccggctccgccttgccctccggactcagatctcgatagggtaccaatggccagttaacagatccagctgctgctgttctagggttcacaagtctgcctatttgtcttccccaatggagctatggttgtctggtctggtccttggtcgtgtcccgtttcattgtgtactatttacctgtaatgtgtatccttaagtctggtttgatggtgtctgaaacgttttgctgtggtagagcagcatggaagaactataatgaataagtgatccctaatcattgtgtccaaattttgcttctgctatacccttttgtgctgtttcttatgttttgcttaaaaatttgatctgacaaacaaatttgtctaaattatgctcttgttctgactgtgtactgtacacatttgtattgctaccggtttggcacatagttttctctttgattgcagatcaaacccttctgattgcagattgcttggctatggctgatgtgctcactgttcttctttagcttgtatattgctgatggtggcttggctacggctgaaaaagttgctgctgcgccgacttggcaactgttgctccagtaatgctttgtcctctcttcctagccgccgacttggcacttggcagctgttgctcctgtaatgcgttgttatctcttatctcttgagatgtactatgattttgaggctgtttgacttgtgccagattgccagtgctgatgctatattatctcaggtttttatgctagtatatgttttactgtgtgctgcctgtgtcgagttacgtaatctattgaaccgctatgcgtgttgatgccctgttgttgcttgccagattgatgcccctgttgcttgcagcttgcaagctgtagtgaaatcctaaaattcgaaaccaaatctattctgaacttttgaagatctgtgatgtccggaagaaaagattcaaacagataaacgggactctccagaatctataaaataaatgatcgacaaacgctttgctttggtaggcttcctagttagttagcggaccgaagcttcggtccgggcctagaaggccagcttcggccgccccgggcaactttattatacaaagttgatagatcgaataacttcgtatagcatacattatacgaagttatacctggtggcgccgctaggggctgcaggaattcgatatcaagcttatcgataccgtcgacctcgagggggggcccggtaccctgggatctgcccttactttaacgcctctaaccaacacccctttatctttataaggaacaataaacagaatttgccccactgttctaaatcacctaataatatccccagctaaaaacaataaaggtttcctagaattaagacaagcatgactgttcctccaggagggtttggaacattgttgcagtcttgcagatacgggcgaagggtgagaaacagagcggagggctggaggtgacctcggtagtcgacgccggagttgagcttgacaacgacggggcggcccctgatggacttgaggaagtccgatggcgtcttcaccgtcccgccggcgcccgaggcgggcctgtcgctgccgccgccgccgctgctcatcttgcgcgctgtgcccccggcggtgtccctgtgttgcggatcgcgggtgggccaggtggatgcgagggcgacccgtttggactccggccggagccgccggatccctggtcggtgtcagtgccgtttactctgggccccacgtgtcagtaccgtctgtagatgacaacaacccgtcgtccacagtcatgtccaaaatatcctttcttcttttttttcgattcggatatctatcttccttttttttttccaaaaatcttcttgacgcaccagcgcgcacgtttgtggtaaacgccgacacgtcggtcccacgtcgatagaccccacccaccagtgagtagcgtgtacgtattcgggggtgacggacgtgtcgccgtcgtcttgctagtcccattcccatctgagccacacatctctgaacaaaaaaaaggagggaggcctccacgcacatccccctccgtgccacccgccccaaaccctcgcgccgcctccgagacagccgccgcaaccatggccaccgccgccgccgcgtctaccgcgctcactggcgccactaccgctgcgcccaaggcgaggcgccgggcgcacctcctggccacccgccgcgccctcgccgcgcccatcaggtgctcagcggcgtcacccgccatgccgatggctcccccggccaccccgctccggccgtggggccccaccgagccccgcaagggtgctgacatcctcgtcgagtccctcgagcgctgcggcgtccgcgacgtcttcgcctaccccggcggcgcgtccatggagatccaccaggcactcacccgctcccccgtcatcgccaaccacctcttccgccacgagcaaggggaggcctttgccgcctccggctacgcgcgctcctcgggccgcgtcggcgtctgcatcgccacctccggccccggcgccaccaacctagtctccgcgctcgccgacgcgctgctcgattccgtccccatggtcgccatcacgggacaggtggcgcgacgcatgattggcaccgacgccttccaggagacgcccatcgtcgaggtcacccgctccatcaccaagcacaactacctggtcctcgacgtcgacgacatcccccgcgtcgtgcaggaggctttcttcctcgcctcctctggtcgaccagggccggtgcttgtcgacatccccaaggacatccagcagcagatggcggtgcctgtctgggacaagcccatgagtctgcctgggtacattgcgcgccttcccaagccccctgcgactgagttgcttgagcaggtgctgcgtcttgttggtgaatcgcggcgccctgttctttatgtgggcggtggctgcgcagcatctggtgaggagttgcgacgctttgtggagctgactggaatcccggtcacaactactcttatgggcctcggcaacttccccagcgacgacccactgtctctgcgcatgctaggtatgcatgggacggtgtatgcaaattatgcagtggataaggccgatctgttgcttgcacttggtgtgcggtttgatgatcgcgtgacagggaagattgaggcttttgcaagcagggctaagattgtgcacgttgatattgatccggctgagattggcaagaacaagcagccacatgtgtccatctgtgcagatgttaagcttgctttgcagggcatgaatgctcttcttgaaggaagcacatcaaagaagagctttgactttggctcatggaacgatgagttggatcagcagaagagggaattcccccttgggtataaaacatctaatgaggagatccagccacaatatgctattcaggttcttgatgagctgacgaaaggcgaggccatcatcggcacaggtgttgggcagcaccagatgtgggcggcacagtactacacttacaagcggccaaggcagtggttgtcttcagctggtcttggggctatgggatttggtttgccggctgctgctggtgcttctgtggcaaacccaggtgtcactgttgttgacatcgatggagatggtagctttctcatgaacgttcaggagctagctatgatccgaattgagaacctcccagtgaaggtctttgtgctaaacaaccagcacctggggatggtggtgcagttggaggacaggttctataaggccaacagagcgcacacatacttgggaaacccagagaatgaaagtgagatatatccagatttcgtgacgatcgccaaagggttcaacattccagcggtccgtgtgacaaagaagaacgaagtccgcgcagcgataaagaagatgctcgagactccagggccgtacctcttggatataatcgtcccacaccaggagcatgtgttgcctatgatccctagtggtggggctttcaaggatatgatcctggatggtgatggcaggactgtgtactgactagctagtcagttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgcctgcagagttaacggcgcgccgactagctagctaaggtaccgagctcgaattcattccgattaatcgtggcctcttgctcttcaggatgaagagctatgtttaaacgtgcaagcgctactagacaattcagtacattaaaaacgtccgcaatgtgttattaagttgtctaagcgtcaatttgtttacaccacaatatatcctgcca

SEQ ID NO: 70 - DNA, 18716 bp, Artificial sequence
  Synthetic construct
gtttacccgccaatatatcctgtcaaacactgatagtttaaactgaaggcgggaaacgacaatctgatcatgagcggagaattaagggagtcacgttatgacccccgccgatgacgcgggacaagccgttttacgtttggaactgacagaaccgcaacgttgaaggagccactcagcaagctggtacgattgtaatacgactcactatagggcgaattgagcgctgtttaaacgctcttcaactggaagagcggttacgctgtttaaacgctcttcaactggaagagcggttactaccggttcactagctagctgctaaggttaccagagctggtcacctttgtccaccaacttattaagtatctagttgaagacacgttcttcttcacgtaagaagacactcagtagtcttcggccagaatggcctcttgattcagcgggcctagaaggccggatcactgactagctaatttaaatcctgaggatctggtcttcctaaggacccgggatatcggaccgattaaactttaattcggtccgataacttcgtatagcatacattatacgaagttatatgcatacgcgtcttaagtcgatcgctatcaactttgtatagaaaagttgggccgagctcggtacggccagaatggcccggaccgggttaccgaattcaggcgacccatcgctgctttgtctacatcatgttcttcatcatcctccccaggcgacgcgtgctgctgttcttattcagactaccgttcgagtgactgcatggcgtacatctttctgcatcgactttgtacggctacatcgaacatatacacgagatgtctcgtgtgaatagagtcactaatgccttaagcatcggttactccgtagggtacattctgttcttcttatttgtgcatatttttattgttgtttactgattatacgagtagttatacatacatgcacatacatatcatcacatatatcacaatatttttctaaattaaattaaaactaaaaatgactaaatttctaacaccaacgacattgtaatgttttctccaacaactttacctattctacattgttctatttcgaatttcactctataaacaacatagtctacaatggaaaacagtgctttgtacgactatatacgcgatgtgtggctacaacataagacaatatagtcgtttgaagattgaacctatatatcggtacggttaatccgtctatgtacgtgggcatgacgaacacccgtgataacgaaggattaacgtgcacaatcataaatccaaagtaggagcggtgcatgatgagaatcgctctcagtactcgacataatgaaccttacgaggtacaacaggcaggcaggcagggaccaggggccgcctttatttcaggctcgctggccccacgggcgtgctgcgtgcacgaagggcactaccccaacctctcaccgaaaaccgcgctggatcggcaaatcaaacgaggtggtgccccgtgcccactctccacgtccacggcaccatccctctgcagccgctcaccagccatgccgtgtcgcggaacggcacaaccacccccaacccactcacgaaaccccgtcccggccgtgcccgtgtcggtccgcgctcggcaacgaggcggcccgcgctgctgagtcccctggacacccgacaccctgtcggccctttgtttattcatcccgaaatctcatctgcccccacggccgactgcgctgcgccgcccggatatatatacccatcgttatcgatcgactggggactctatcagtgatagagtctagaggatcgctcaggaaggccgctgagatagaggcatggcggccaatgcgggcggcggtggagcgggaggaggcagcggcagcggcagcgtggctgcgccggcggtgtgccgccccagcggctcgcggtggacgccgacgccggagcagatcaggatgctgaaggagctctactacggctgcggcatccggtcgcccagctcggagcagatccagcgcatcaccgccatgctgcggcagcacggcaagatcgagggcaagaacgtcttctactggttccagaaccacaaggcccgcgagcgccagaagcgccgcctcaccagcctcgacgtcaacgtgcccgccgccggcgcggccgacgccaccaccagccaactcggcgtcctctcgctgtcgtcgccgccgccttcaggcgcggcgcctccctcgcccaccctcggcttctacgccgccggcaatggcggcggatcggctgtgctgctggacacgagttccgactggggcagcagcggcgctgccatggccaccgagacatgcttcctgcaggactacatgggcgtgacggacacgggcagctcgtcgcagtggccacgcttctcgtcgtcggacacgataatggcggcggccgcggcgcgggcggcgacgacgcgggcgcccgagacgctccctctcttcccgacctgcggcgacgacggcggcagcggtagcagcagctacttgccgttctggggtgccgcgtccacaactgccggcgccacttcttccgttgcgatccagcagcaacaccagctgcaggagcagtacagcttttacagcaacagcaacagcacccagctggccggcaccggcaaccaagacgtatcggcaacagcagcagcagccgccgccctggagctgagcctcagctcatggtgctccccttaccctgctgcagggagtatgtgagagcaacgcgagctgccactgctcttcactggtaccgttaacagatcattcgacaaagcagcattagtccgttgatcggtggaagaccactcgtcagtgttgagttgaatgtttgatcaataaaatacggcaatgctgtaagggttgttttttatgccattgataatacactgtactgttcagttgttgaactctatttcttagccatgccaagtgcttttcttattttgaataacattacagcaaaaagttgaaagacaaaaaaaaaaacccccgaacagagtgctttgggtcccaagcttctttagactgtgttcggcgttccccctaaatttctccccctatatctcactcacttgtcacatcagcgttctctttccccctatatctccacgctctacagcagttccacctatatcaaacctctataccccaccacaacaatattatatactttcatcttcaactaactcatgtaccttccaatttttttctactaataattatttacgtgcacagaaacttagcaaggagagagagagcggggtgacccaccttgctagttggatattacctcttctcttcaaagtatccttgaacgctcaccggttatcaaatctctacactatagctctgtagtcttgctagatagttagttctttagctctcggtgaccaagcttggcgcgatcaagcttatcgataccgtcgacctcgaagcttggtcacccggtccgggcctagaaggccagcttcaagtttgtacaaaaaagcaggctccggccagaatggcccggaccgggttaccgaattcttaccctagctccctgcggctgttacgcggtcccccatcaatcttctgttcttgcggttgtagcctgtgtaacagtgctagagtatgtatgataaataggttttaagtctgcttacatgacattttttattgtggaagagacatataaaaattagagagagtggttctcatgcaacggcggacggcccggtgctaaaagagcttcaagacaaaataatgaaacaggaagagagtagatttatctaagagccaactttattatatgaatgtgtttattgttggctttagatgatatggtaaggagttagagctaataatagataggctctattattattattattaattaaactcgctctaaggaggaaagtgggaggaagggacgaggacgaagactactggaagcatcgtgcatggatgatggatgtggtgtctcttaatgtaggtggccggaggatgtacgtgttaattgcgcgataagcactcagatccaaccgcaaactacctccacactgacacactgatagagagaaagagagacctccgacgactgccgccgcagatgagccacgtacgtatacgacgtctgccggccggctcaggctgccgccatcaccctgctcgaaagtcgcgttaggcggcgccagctacataggagtatctagtctagccagttagtatactactactgcgctgatgatgaattaactctgcatagatactgtacttgcctccctccaacacccaaccacctcctgctcggctcttaataacttggacacggatcgatgccatccaaggaagaacacgacgacgacgacggaacatccaccatgcaagcttgcatccatacgccgatacgcgtgcatccatccatccaccattatttccattttccaccgatcacacgtacacaggcctatttaaggagcgacatcccactgcaactctcctcaccactcatcaccagctagctctagcaaagcacttgccatctaccgaccgccgcattccaaacagcccgacgagctagcagagcggcaggcacctccctcctcaaggaacccatggccactgtgaacaactggctcgctttctccctctccccgcaggagctgccgccctcccagacgacggactccacactcatctcggccgccaccgccgaccatgtctccggcgatgtctgcttcaacatcccccaagattggagcatgaggggatcagagctttcggcgctcgtcgcggagccgaagctggaggacttcctcggcggcatctccttctccgagcagcatcacaaggccaactgcaacatgatacccagcactagcagcacagtttgctacgcgagctcaggtgctagcaccggctaccatcaccagctgtaccaccagcccaccagctcagcgctccacttcgcggactccgtaatggtggcttcctcggccggtgtccacgacggcggtgccatgctcagcgcggccgccgctaacggtgtcgctggcgctgccagtgccaacggcggcggcatcgggctgtccatgattaagaactggctgcggagccaaccggcgcccatgcagccgagggtggcggcggctgagggcgcgcaggggctctctttgtccatgaacatggcggggacgacccaaggcgctgctggcatgccacttctcgctggagagcgcgcacgggcgcccgagagtgtatcgacgtcagcacagggtggagccgtcgtcgtcacggcgccgaaggaggatagcggtggcagcggtgttgccggcgctctagtagccgtgagcacggacacgggtggcagcggcggcgcgtcggctgacaacacggcaaggaagacggtggacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggaaggatgtctgcatgggggactgtcgtgtctgcagccgcggcggcagcagcaagcagcaacgacaacatggccgccgacgtcgggcatggcggcgcgcagctcttcagtgtctggaacgacacttaagcgtacctagtggtacctgacatcttatagtctgcaacctctcgtgtctgaattcctatctttatcaagtgttattgcttccacgactataggacagctttcgtcgaaagcttttgctcatgtgatctcgaaggattcatctagtctgatttttcgtgacttgtatcggttttattggattcatccaacatatatcaataaaaaatgagttgtgtttcctttcttcctagttcagttaaaattatttccctcctgcgcttgtgctgtaattgtctgtgtacctgttgtttgtgactgtgttagttcccttggatatgatttcgtatttgatatgtacatggagatagcttagcttcattattggagtatgaagttagtatgacatagtcactctcctggaaaattgacactgcaaaccatatttttattctgaaccacaaatcctagtcagtccgctggcatatgccgtccgtttgctgaatccagaacgtgggtttggagatgtacggctgagatgcctctatgcgaaggggatttcgtggtgaaacgagatgggagtagagcaacgcccgtggaagatgcttcaaacttccacacttttgagcaacgatcggcagtagtaaggtagacgatttcaagatcaaagcatatgaagataaacaacatcaacaacaaaatttgttggggttctatagagagaaacagagctacatacatacactgttttgtatctaccatctgagatgatgaaaagatgaaaaactaaagaatgccccggcgccaacgccaggacacgccgcgcgcgcgtcacccgagccatctcttgacccagccggcgctgtatatttacacacgttgcagcatcgatcaccacctgttcgatcgcgtcgccgtcaccgggatctgagtcgaaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcgaccttcttatgtgcttctagtctccaaatgtggttgatagttattttgctctaagatcaacagtaatgaagtataaatcatcgttgtggtgtgctactcggttaattgagcattaacacacacaaacatgacgaggatggtataatctccaaaaatgtgtactttgttaggtgggaccctatagccttgattaatgtgctatgttaggcatgcctggaaacgtgtgacgcatatgttttgtgaacctgttgatattatatgtgcttttatattaccatattttattaaaatactaatatttattactagtaagatataacattctatctagcttaaaaactaaccataaatattccataataactagatttaccaaactaatatactaaatatacataataaatacaaaattaacaagacaataatcaatatttatgagcttaatatatttagacattatggttggtcgacgataatcatgctaacttttcgtaattgcttgattgaaatatgcttagaataatgcctctttgttctacatggcaaatagggaccattatggtgtaacaccctgggaaccacaaacaccccgaaatgctactaaactacacaactaaccttcatatataaaatttcgacagcatctcctttgaaaatttgcatagacgtggaagcaacagagtataaacagatatcatgataagaaaacatactagacattaataatctgctagaaatgggaagaatcctaacttgacgactgcgtaactgactagagtcacacttagctgaccctagtcacttacaactgacttcgtgtcctagatcgatgggccctggccgaagcttggtcacccggtccgggcctagaaggccagcttcaagtttgtacaaaaaagcaggctccggccagaatggcccggaccgaagctggccgctctagaactagtggatctcgatgtgtagtctacgagaagggttaaccgtctcttcgtgagaataaccgtggcctaaaaataagccgatgaggataaataaaatgtggtggtacagtacttcaagaggtttactcatcaagaggatgcttttccgatgagctctagtagtacatcggacctcacatacctccattgtggtgaaatattttgtgctcatttagtgatgggtaaattttgtttatgtcactctaggttttgacatttcagttttgccactcttaggttttgacaaataatttccattccgcggcaaaagcaaaacaattttattttacttttaccactcttagctttcacaatgtatcacaaatgccactctagaaattctgtttatgccacagaatgtgaaaaaaaacactcacttatttgaagccaaggtgttcatggcatggaaatgtgacataaagtaacgttcgtgtataagaaaaaattgtactcctcgtaacaagagacggaaacatcatgagacaatcgcgtttggaaggctttgcatcacctttggatgatgcgcatgaatggagtcgtctgcttgctagccttcgcctaccgcccactgagtccgggcggcaactaccatcggcgaacgacccagctgacctctaccgaccggacttgaatgcgctaccttcgtcagcgacgatggccgcgtacgctggcgacgtgcccccgcatgcatggcggcacatggcgagctcagaccgtgcgtggctggctacaaatacgtaccccgtgagtgccctagctagaaacttacacctgcaactgcgagagcgagcgtgtgagtgtagccgagtagatcccccgggctgcaggtcgactctagaggatccgaaggagatagaaccgatccaccatgtccaacctgctcacggttcaccagaaccttccggctcttccagtggacgcgacgtccgatgaagtcaggaagaacctcatggacatgttccgcgacaggcaagcgttcagcgagcacacctggaagatgctgctctccgtctgccgctcctgggctgcatggtgcaagctgaacaacaggaagtggttccccgctgagcccgaggacgtgagggattaccttctgtacctgcaagcgcgaggtttgtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgcctaggtctggcagtgaagaccatccagcaacaccttggacaactgaacatgcttcacaggcgctccggcctcccgcgccccagcgactcgaacgccgtgagcctcgtcatgcgccgcatcaggaaggaaaacgtcgatgccggcgaaagggcaaagcaggccctcgcgttcgagaggaccgatttcgaccaggtccgcagcctgatggagaacagcgacaggtgccaggacattaggaacctggcgttcctcggaattgcatacaacacgctcctcaggatcgcggaaattgcccgcattcgcgtgaaggacattagccgcaccgacggcggcaggatgcttatccacattggcaggaccaagacgctcgtttccaccgcaggcgtcgaaaaggccctcagcctcggagtgaccaagctcgtcgaacgctggatctccgtgtccggcgtcgcggacgacccaaacaactacctcttctgccgcgtccgcaagaacggggtggctgcccctagcgccaccagccaactcagcacgagggccttggaaggtattttcgaggccacccaccgcctgatctacggcgcgaaggatgacagcggtcaacgctacctcgcatggtccgggcactccgcccgcgttggagctgctagggacatggcccgcgccggtgtttccatccccgaaatcatgcaggcgggtggatggacgaacgtgaacattgtcatgaactacattcgcaaccttgacagcgagacgggcgcaatggttcgcctcctggaagatggtgactgagctagacccagctttcttgtacaaagtggccgttaacggatccagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaattgcggcaagcttcggccgccccagcttggtcacccggtccgggcctagaaggccgatctcccgggcacccagctttcttgtacaaagtggccgttaacggatcggccagaatggcccggaccgggttaccgaattcctgcccttaaggccaattgttcaagattcattcaacaattgaaacatctcccatgattaaatcagtataaggttgctatggtcttgcttgacaaagtttttttttgagggaatttcaactaaatttttgagtgaaactatcaaatactgattttaaaaaatttttataaaaggaagcgcagagataaaaggccatctatgctacaaaagtacccaaaaatgtaatcctaaagtatgaattgcattttttttttgtttggacgaaaggaaaggagtattaccacaagaatgatatcatcttcatatttagatcttttttgggtaaagcttgagattctctaaatatagagaaatcagaagaaaaaaaaaccgtgttttggtggttttgatttctagcctccacaataactttgacggcgtcgacaagtctaacggacaccaagcagcgaaccaccagcgccgagccaagcgaagcagacggccgagacgttgacaccttcggcgcggcatctctcgagagttccgctccggcgctccacctccaccgctggcggtttcttattccgttccgttccgcctcctgctctgctcctctccacaccacacggcacgaaaccgttacggcaccggcagcacccagcacgggagaggggattcctttcccaccgttccttccctttccgccccgccgctataaatagccagccccatccccagcttttttccccaatctcatctcctctctcctgttgttcggagcacacgcacaatccgatcgatccccaaatccccttcgtctctcctcgcgagcctcgtggatcccagcttcaaggtacggcgatcgatcatcccccctccttctctctaccttcttttctctagactacatcggatggcgatccatggttagggcctgctagtttcccttcctgttttgtcgatggctgcgaggcacaatagatctgatggcgttatgacggctaacttgtcatgttgttgcgatttatagtccctttaggagatcagtttaatttctcggatggttcgagatcggtggtccatggttagtaccctaagatccgcgctgttagggttcgtagatggaggcgacctgttctgattgttaacttgtcagtacctgggaaatcctgggatggttctagctcgtccgcagatgagatcgatttcatgatcctctgtatcttgtttcgttgcctaggttccgtctaatctatccgtggtatgatgtagatgttttgatcgtgctaactacgtcttgtaaagttaattgtcaggtcataatttttagcatgcctttttttttgtttggttttgtctaattgggctgtcgttctagatcagagtagaagactgttccaaactacctgctggatttattgaacttggatctgtatgtgtgtcacatatcttcataaattcatgattaagatggattgaaatatcttttatctttttggtatggatagttctatatgttggtgtggctttgttagatgtatacatgcttagatacatgaagcaacgtgctgctactgtttagtaattgctgttcatttgtctaataaacagataaggatatgtatttatgttgctgttggttttgctggtactttgttggatacaaatgcttcaatacagaaaacagcatgctgctacgatttaccatttatctaatcttatcatatgtctaatctaataaacaaacatgcttttaaattatcttcatatgcttggatgatggcatacacagcggctatgtgtggttttttaaatacccagcatcatgggcatgcatgacactgctttaatatgctttttatttgcttgagactgtttcttttgtttatactgaccctttagttcggtgactcttctgcaggtcgactttaacttagcctaggatccatggcccagtccaagcacggcctgaccaaggagatgaccatgaagtaccgcatggagggctgcgtggacggccacaagttcgtgatcaccggcgagggcatcggctaccccttcaagggcaagcaggccatcaacctgtgcgtggtggagggcggccccttgcccttcgccgaggacatcttgtccgccgccttcatgtacggcaaccgcgtgttcaccgagtacccccaggacatcgtcgactacttcaagaactcctgccccgccggctacacctgggaccgctccttcctgttcgaggacggcgccgtgtgcatctgcaacgccgacatcaccgtgagcgtggaggagaactgcatgtaccacgagtccaagttctacggcgtgaacttccccgccgacggccccgtgatgaagaagatgaccgacaactgggagccctcctgcgagaagatcatccccgtgcccaagcagggcatcttgaagggcgacgtgagcatgtacctgctgctgaaggacggtggccgcttgcgctgccagttcgacaccgtgtacaaggccaagtccgtgccccgcaagatgcccgactggcacttcatccagcacaagctgacccgcgaggaccgcagcgacgccaagaaccagaagtggcacctgaccgagcacgccatcgcctccggctccgccttgccctccggactcagatctcgatagggtaccaatggccagttaacagatccagctgctgctgttctagggttcacaagtctgcctatttgtcttccccaatggagctatggttgtctggtctggtccttggtcgtgtcccgtttcattgtgtactatttacctgtaatgtgtatccttaagtctggtttgatggtgtctgaaacgttttgctgtggtagagcagcatggaagaactataatgaataagtgatccctaatcattgtgtccaaattttgcttctgctatacccttttgtgctgtttcttatgttttgcttaaaaatttgatctgacaaacaaatttgtctaaattatgctcttgttctgactgtgtactgtacacatttgtattgctaccggtttggcacatagttttctctttgattgcagatcaaacccttctgattgcagattgcttggctatggctgatgtgctcactgttcttctttagcttgtatattgctgatggtggcttggctacggctgaaaaagttgctgctgcgccgacttggcaactgttgctccagtaatgctttgtcctctcttcctagccgccgacttggcacttggcagctgttgctcctgtaatgcgttgttatctcttatctcttgagatgtactatgattttgaggctgtttgacttgtgccagattgccagtgctgatgctatattatctcaggtttttatgctagtatatgttttactgtgtgctgcctgtgtcgagttacgtaatctattgaaccgctatgcgtgttgatgccctgttgttgcttgccagattgatgcccctgttgcttgcagcttgcaagctgtagtgaaatcctaaaattcgaaaccaaatctattctgaacttttgaagatctgtgatgtccggaagaaaagattcaaacagataaacgggactctccagaatctataaaataaatgatcgacaaacgctttgctttggtaggcttcctagttagttagcggaccgaagcttcggtccgggcctagaaggccagcttcggccgccccgggcaactttattatacaaagttgatagatcgaataacttcgtatagcatacattatacgaagttatacctggtggcgccgctaggggctgcaggaattcgatatcaagcttatcgataccgtcgacctcgagggggggcccggtaccctgggatctgcccttactttaacgcctctaaccaacacccctttatctttataaggaacaataaacagaatttgccccactgttctaaatcacctaataatatccccagctaaaaacaataaaggtttcctagaattaagacaagcatgactgttcctccaggagggtttggaacattgttgcagtcttgcagatacgggcgaagggtgagaaacagagcggagggctggaggtgacctcggtagtcgacgccggagttgagcttgacaacgacggggcggcccctgatggacttgaggaagtccgatggcgtcttcaccgtcccgccggcgcccgaggcgggcctgtcgctgccgccgccgccgctgctcatcttgcgcgctgtgcccccggcggtgtccctgtgttgcggatcgcgggtgggccaggtggatgcgagggcgacccgtttggactccggccggagccgccggatccctggtcggtgtcagtgccgtttactctgggccccacgtgtcagtaccgtctgtagatgacaacaacccgtcgtccacagtcatgtccaaaatatcctttcttcttttttttcgattcggatatctatcttccttttttttttccaaaaatcttcttgacgcaccagcgcgcacgtttgtggtaaacgccgacacgtcggtcccacgtcgatagaccccacccaccagtgagtagcgtgtacgtattcgggggtgacggacgtgtcgccgtcgtcttgctagtcccattcccatctgagccacacatctctgaacaaaaaaaaggagggaggcctccacgcacatccccctccgtgccacccgccccaaaccctcgcgccgcctccgagacagccgccgcaaccatggccaccgccgccgccgcgtctaccgcgctcactggcgccactaccgctgcgcccaaggcgaggcgccgggcgcacctcctggccacccgccgcgccctcgccgcgcccatcaggtgctcagcggcgtcacccgccatgccgatggctcccccggccaccccgctccggccgtggggccccaccgagccccgcaagggtgctgacatcctcgtcgagtccctcgagcgctgcggcgtccgcgacgtcttcgcctaccccggcggcgcgtccatggagatccaccaggcactcacccgctcccccgtcatcgccaaccacctcttccgccacgagcaaggggaggcctttgccgcctccggctacgcgcgctcctcgggccgcgtcggcgtctgcatcgccacctccggccccggcgccaccaacctagtctccgcgctcgccgacgcgctgctcgattccgtccccatggtcgccatcacgggacaggtggcgcgacgcatgattggcaccgacgccttccaggagacgcccatcgtcgaggtcacccgctccatcaccaagcacaactacctggtcctcgacgtcgacgacatcccccgcgtcgtgcaggaggctttcttcctcgcctcctctggtcgaccagggccggtgcttgtcgacatccccaaggacatccagcagcagatggcggtgcctgtctgggacaagcccatgagtctgcctgggtacattgcgcgccttcccaagccccctgcgactgagttgcttgagcaggtgctgcgtcttgttggtgaatcgcggcgccctgttctttatgtgggcggtggctgcgcagcatctggtgaggagttgcgacgctttgtggagctgactggaatcccggtcacaactactcttatgggcctcggcaacttccccagcgacgacccactgtctctgcgcatgctaggtatgcatgggacggtgtatgcaaattatgcagtggataaggccgatctgttgcttgcacttggtgtgcggtttgatgatcgcgtgacagggaagattgaggcttttgcaagcagggctaagattgtgcacgttgatattgatccggctgagattggcaagaacaagcagccacatgtgtccatctgtgcagatgttaagcttgctttgcagggcatgaatgctcttcttgaaggaagcacatcaaagaagagctttgactttggctcatggaacgatgagttggatcagcagaagagggaattcccccttgggtataaaacatctaatgaggagatccagccacaatatgctattcaggttcttgatgagctgacgaaaggcgaggccatcatcggcacaggtgttgggcagcaccagatgtgggcggcacagtactacacttacaagcggccaaggcagtggttgtcttcagctggtcttggggctatgggatttggtttgccggctgctgctggtgcttctgtggcaaacccaggtgtcactgttgttgacatcgatggagatggtagctttctcatgaacgttcaggagctagctatgatccgaattgagaacctcccagtgaaggtctttgtgctaaacaaccagcacctggggatggtggtgcagttggaggacaggttctataaggccaacagagcgcacacatacttgggaaacccagagaatgaaagtgagatatatccagatttcgtgacgatcgccaaagggttcaacattccagcggtccgtgtgacaaagaagaacgaagtccgcgcagcgataaagaagatgctcgagactccagggccgtacctcttggatataatcgtcccacaccaggagcatgtgttgcctatgatccctagtggtggggctttcaaggatatgatcctggatggtgatggcaggactgtgtactgactagctagtcagttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgcctgcagagttaacggcgcgccgactagctagctaaggtaccgagctcgaattcattccgattaatcgtggcctcttgctcttcaggatgaagagctatgtttaaacgtgcaagcgctactagacaattcagtacattaaaaacgtccgcaatgtgttattaagttgtctaagcgtcaatttgtttacaccacaatatatcctgcca

SEQ ID NO: 71 - DNA, 13825 bp, Artificial sequence
  Synthetic construct
gtttacccgccaatatatcctgtcaaacactgatagtttaaactgaaggcgggaaacgacaatctgatcatgagcggagaattaagggagtcacgttatgacccccgccgatgacgcgggacaagccgttttacgtttggaactgacagaaccgcaacgttgaaggagccactcagcaagctggtacgattgtaatacgactcactatagggcgaattgagcgctgtttaaacgctcttcaactggaagagcggttacgctgtttaaacgctcttcaactggaagagcggttactaccggttcactagctagctgctaatcgagctagttaccctatgaggtgacatgaagcgctcacggttactatgacggttagcttcacgactgttggtggcagtagcgtacgacttagctatagttccggacttacccttaagcgatttaaatcctgaggatatcgctatcaactttgtatagaaaagttgggccgagctcggtacggccagaatggcccggaccgggttaccgaattcaggcgacccatcgctgctttgtctacatcatgttcttcatcatcctccccaggcgacgcgtgctgctgttcttattcagactaccgttcgagtgactgcatggcgtacatctttctgcatcgactttgtacggctacatcgaacatatacacgagatgtctcgtgtgaatagagtcactaatgccttaagcatcggttactccgtagggtacattctgttcttcttatttgtgcatatttttattgttgtttactgattatacgagtagttatacatacatgcacatacatatcatcacatatatcacaatatttttctaaattaaattaaaactaaaaatgactaaatttctaacaccaacgacattgtaatgttttctccaacaactttacctattctacattgttctatttcgaatttcactctataaacaacatagtctacaatggaaaacagtgctttgtacgactatatacgcgatgtgtggctacaacataagacaatatagtcgtttgaagattgaacctatatatcggtacggttaatccgtctatgtacgtgggcatgacgaacacccgtgataacgaaggattaacgtgcacaatcataaatccaaagtaggagcggtgcatgatgagaatcgctctcagtactcgacataatgaaccttacgaggtacaacaggcaggcaggcagggaccaggggccgcctttatttcaggctcgctggccccacgggcgtgctgcgtgcacgaagggcactaccccaacctctcaccgaaaaccgcgctggatcggcaaatcaaacgaggtggtgccccgtgcccactctccacgtccacggcaccatccctctgcagccgctcaccagccatgccgtgtcgcggaacggcacaaccacccccaacccactcacgaaaccccgtcccggccgtgcccgtgtcggtccgcgctcggcaacgaggcggcccgcgctgctgagtcccctggacacccgacaccctgtcggccctttgtttattcatcccgaaatctcatctgcccccacggccgactgcgctgcgccgcccggatatatatacccatcgttatcgatcgactggggactctatcagtgatagagtctagaggatcgctcaggaaggccgctgagatagaggcatggcggccaatgcgggcggcggtggagcgggaggaggcagcggcagcggcagcgtggctgcgccggcggtgtgccgccccagcggctcgcggtggacgccgacgccggagcagatcaggatgctgaaggagctctactacggctgcggcatccggtcgcccagctcggagcagatccagcgcatcaccgccatgctgcggcagcacggcaagatcgagggcaagaacgtcttctactggttccagaaccacaaggcccgcgagcgccagaagcgccgcctcaccagcctcgacgtcaacgtgcccgccgccggcgcggccgacgccaccaccagccaactcggcgtcctctcgctgtcgtcgccgccgccttcaggcgcggcgcctccctcgcccaccctcggcttctacgccgccggcaatggcggcggatcggctgtgctgctggacacgagttccgactggggcagcagcggcgctgccatggccaccgagacatgcttcctgcaggactacatgggcgtgacggacacgggcagctcgtcgcagtggccacgcttctcgtcgtcggacacgataatggcggcggccgcggcgcgggcggcgacgacgcgggcgcccgagacgctccctctcttcccgacctgcggcgacgacggcggcagcggtagcagcagctacttgccgttctggggtgccgcgtccacaactgccggcgccacttcttccgttgcgatccagcagcaacaccagctgcaggagcagtacagcttttacagcaacagcaacagcacccagctggccggcaccggcaaccaagacgtatcggcaacagcagcagcagccgccgccctggagctgagcctcagctcatggtgctccccttaccctgctgcagggagtatgtgagagcaacgcgagctgccactgctcttcactggtaccgttaacagatcattcgacaaagcagcattagtccgttgatcggtggaagaccactcgtcagtgttgagttgaatgtttgatcaataaaatacggcaatgctgtaagggttgttttttatgccattgataatacactgtactgttcagttgttgaactctatttcttagccatgccaagtgcttttcttattttgaataacattacagcaaaaagttgaaagacaaaaaaaaaaacccccgaacagagtgctttgggtcccaagcttctttagactgtgttcggcgttccccctaaatttctccccctatatctcactcacttgtcacatcagcgttctctttccccctatatctccacgctctacagcagttccacctatatcaaacctctataccccaccacaacaatattatatactttcatcttcaactaactcatgtaccttccaatttttttctactaataattatttacgtgcacagaaacttagcaaggagagagagagcggggtgacccaccttgctagttggatattacctcttctcttcaaagtatccttgaacgctcaccggttatcaaatctctacactatagctctgtagtcttgctagatagttagttctttagctctcggtgaccaagcttggcgcgatcaagcttatcgataccgtcgacctcgaagcttggtcacccggtccgggcctagaaggccagcttcaagtttgtacaaaaaagcaggctccggccagaatggcccggaccgggttaccgaattcttaccctagctccctgcggctgttacgcggtcccccatcaatcttctgttcttgcggttgtagcctgtgtaacagtgctagagtatgtatgataaataggttttaagtctgcttacatgacattttttattgtggaagagacatataaaaattagagagagtggttctcatgcaacggcggacggcccggtgctaaaagagcttcaagacaaaataatgaaacaggaagagagtagatttatctaagagccaactttattatatgaatgtgtttattgttggctttagatgatatggtaaggagttagagctaataatagataggctctattattattattattaattaaactcgctctaaggaggaaagtgggaggaagggacgaggacgaagactactggaagcatcgtgcatggatgatggatgtggtgtctcttaatgtaggtggccggaggatgtacgtgttaattgcgcgataagcactcagatccaaccgcaaactacctccacactgacacactgatagagagaaagagagacctccgacgactgccgccgcagatgagccacgtacgtatacgacgtctgccggccggctcaggctgccgccatcaccctgctcgaaagtcgcgttaggcggcgccagctacataggagtatctagtctagccagttagtatactactactgcgctgatgatgaattaactctgcatagatactgtacttgcctccctccaacacccaaccacctcctgctcggctcttaataacttggacacggatcgatgccatccaaggaagaacacgacgacgacgacggaacatccaccatgcaagcttgcatccatacgccgatacgcgtgcatccatccatccaccattatttccattttccaccgatcacacgtacacaggcctatttaaggagcgacatcccactgcaactctcctcaccactcatcaccagctagctctagcaaagcacttgccatctaccgaccgccgcattccaaacagcccgacgagctagcagagcggcaggcacctccctcctcaaggaacccatggccactgtgaacaactggctcgctttctccctctccccgcaggagctgccgccctcccagacgacggactccacactcatctcggccgccaccgccgaccatgtctccggcgatgtctgcttcaacatcccccaagattggagcatgaggggatcagagctttcggcgctcgtcgcggagccgaagctggaggacttcctcggcggcatctccttctccgagcagcatcacaaggccaactgcaacatgatacccagcactagcagcacagtttgctacgcgagctcaggtgctagcaccggctaccatcaccagctgtaccaccagcccaccagctcagcgctccacttcgcggactccgtaatggtggcttcctcggccggtgtccacgacggcggtgccatgctcagcgcggccgccgctaacggtgtcgctggcgctgccagtgccaacggcggcggcatcgggctgtccatgattaagaactggctgcggagccaaccggcgcccatgcagccgagggtggcggcggctgagggcgcgcaggggctctctttgtccatgaacatggcggggacgacccaaggcgctgctggcatgccacttctcgctggagagcgcgcacgggcgcccgagagtgtatcgacgtcagcacagggtggagccgtcgtcgtcacggcgccgaaggaggatagcggtggcagcggtgttgccggcgctctagtagccgtgagcacggacacgggtggcagcggcggcgcgtcggctgacaacacggcaaggaagacggtggacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggaaggatgtctgcatgggggactgtcgtgtctgcagccgcggcggcagcagcaagcagcaacgacaacatggccgccgacgtcgggcatggcggcgcgcagctcttcagtgtctggaacgacacttaagcgtacctagtggtacctgacatcttatagtctgcaacctctcgtgtctgaattcctatctttatcaagtgttattgcttccacgactataggacagctttcgtcgaaagcttttgctcatgtgatctcgaaggattcatctagtctgatttttcgtgacttgtatcggttttattggattcatccaacatatatcaataaaaaatgagttgtgtttcctttcttcctagttcagttaaaattatttccctcctgcgcttgtgctgtaattgtctgtgtacctgttgtttgtgactgtgttagttcccttggatatgatttcgtatttgatatgtacatggagatagcttagcttcattattggagtatgaagttagtatgacatagtcactctcctggaaaattgacactgcaaaccatatttttattctgaaccacaaatcctagtcagtccgctggcatatgccgtccgtttgctgaatccagaacgtgggtttggagatgtacggctgagatgcctctatgcgaaggggatttcgtggtgaaacgagatgggagtagagcaacgcccgtggaagatgcttcaaacttccacacttttgagcaacgatcggcagtagtaaggtagacgatttcaagatcaaagcatatgaagataaacaacatcaacaacaaaatttgttggggttctatagagagaaacagagctacatacatacactgttttgtatctaccatctgagatgatgaaaagatgaaaaactaaagaatgccccggcgccaacgccaggacacgccgcgcgcgcgtcacccgagccatctcttgacccagccggcgctgtatatttacacacgttgcagcatcgatcaccacctgttcgatcgcgtcgccgtcaccggtaccgagctcgaattccggtccgggcctagaaggccgatctcccgggcacccagctttcttgtacaaagtggccgttaacggatcggccagaatggcccggaccgggttaccgaattcgagctcggtaccctgggatctgcccttactttaacgcctctaaccaacacccctttatctttataaggaacaataaacagaatttgccccactgttctaaatcacctaataatatccccagctaaaaacaataaaggtttcctagaattaagacaagcatgactgttcctccaggagggtttggaacattgttgcagtcttgcagatacgggcgaagggtgagaaacagagcggagggctggaggtgacctcggtagtcgacgccggagttgagcttgacaacgacggggcggcccctgatggacttgaggaagtccgatggcgtcttcaccgtcccgccggcgcccgaggcgggcctgtcgctgccgccgccgccgctgctcatcttgcgcgctgtgcccccggcggtgtccctgtgttgcggatcgcgggtgggccaggtggatgcgagggcgacccgtttggactccggccggagccgccggatccctggtcggtgtcagtgccgtttactctgggccccacgtgtcagtaccgtctgtagatgacaacaacccgtcgtccacagtcatgtccaaaatatcctttcttcttttttttcgattcggatatctatcttccttttttttttccaaaaatcttcttgacgcaccagcgcgcacgtttgtggtaaacgccgacacgtcggtcccacgtcgatagaccccacccaccagtgagtagcgtgtacgtattcgggggtgacggacgtgtcgccgtcgtcttgctagtcccattcccatctgagccacacatctctgaacaaaaaaaaggagggaggcctccacgcacatccccctccgtgccacccgccccaaaccctcgcgccgcctccgagacagccgccgcaaccatggccaccgccgccgccgcgtctaccgcgctcactggcgccactaccgctgcgcccaaggcgaggcgccgggcgcacctcctggccacccgccgcgccctcgccgcgcccatcaggtgctcagcggcgtcacccgccatgccgatggctcccccggccaccccgctccggccgtggggccccaccgagccccgcaagggtgctgacatcctcgtcgagtccctcgagcgctgcggcgtccgcgacgtcttcgcctaccccggcggcgcgtccatggagatccaccaggcactcacccgctcccccgtcatcgccaaccacctcttccgccacgagcaaggggaggcctttgccgcctccggctacgcgcgctcctcgggccgcgtcggcgtctgcatcgccacctccggccccggcgccaccaacctagtctccgcgctcgccgacgcgctgctcgattccgtccccatggtcgccatcacgggacaggtggcgcgacgcatgattggcaccgacgccttccaggagacgcccatcgtcgaggtcacccgctccatcaccaagcacaactacctggtcctcgacgtcgacgacatcccccgcgtcgtgcaggaggctttcttcctcgcctcctctggtcgaccagggccggtgcttgtcgacatccccaaggacatccagcagcagatggcggtgcctgtctgggacaagcccatgagtctgcctgggtacattgcgcgccttcccaagccccctgcgactgagttgcttgagcaggtgctgcgtcttgttggtgaatcgcggcgccctgttctttatgtgggcggtggctgcgcagcatctggtgaggagttgcgacgctttgtggagctgactggaatcccggtcacaactactcttatgggcctcggcaacttccccagcgacgacccactgtctctgcgcatgctaggtatgcatgggacggtgtatgcaaattatgcagtggataaggccgatctgttgcttgcacttggtgtgcggtttgatgatcgcgtgacagggaagattgaggcttttgcaagcagggctaagattgtgcacgttgatattgatccggctgagattggcaagaacaagcagccacatgtgtccatctgtgcagatgttaagcttgctttgcagggcatgaatgctcttcttgaaggaagcacatcaaagaagagctttgactttggctcatggaacgatgagttggatcagcagaagagggaattcccccttgggtataaaacatctaatgaggagatccagccacaatatgctattcaggttcttgatgagctgacgaaaggcgaggccatcatcggcacaggtgttgggcagcaccagatgtgggcggcacagtactacacttacaagcggccaaggcagtggttgtcttcagctggtcttggggctatgggatttggtttgccggctgctgctggtgcttctgtggcaaacccaggtgtcactgttgttgacatcgatggagatggtagctttctcatgaacgttcaggagctagctatgatccgaattgagaacctcccagtgaaggtctttgtgctaaacaaccagcacctggggatggtggtgcagttggaggacaggttctataaggccaacagagcgcacacatacttgggaaacccagagaatgaaagtgagatatatccagatttcgtgacgatcgccaaagggttcaacattccagcggtccgtgtgacaaagaagaacgaagtccgcgcagcgataaagaagatgctcgagactccagggccgtacctcttggatataatcgtcccacaccaggagcatgtgttgcctatgatccctagtggtggggctttcaaggatatgatcctggatggtgatggcaggactgtgtactgactagctagtcagttaacagatctgccagatcctcggtgtacaaataacccgtcttatcctatgagacgggccggcgtcagtgtgttctggaggaatttttatgtcagagcctttttctttgtgtgcttgatgtagatgccaagggaagcttattggctgttgaagcttgatgcaaaataaattatggaactctgttttttgtttatctaataataactagcaaatatgcttccattgcattgaaactaacagccttttgtgtttccaagttttattttgtgacaatgtcatctatttcaattagttgtggaatcggaaacttgcaggactaacttggaaactccaatccctcagcatcctggactttttcctggtgtaatccatgtagatattattttaatcatcattttagttctggaggtttttccatctccggttttgctcccctttcttcaaaaaaaaaaaaaaaatgccgtaggcgccgcaacgcccacctgttgttcaaactcatgggcacgagtggctcgaagattttatacaacaattgctgtagtttcaccgttgctggtgaagaagcatttttttaaaaaaatatagtggtattcattttaattagtttagttgtgcagcgagcaaaatttggacatgctctgctcggaatctgatcgacctagacacagattagcagcagtagctttgtcatctgttccaagagttgcgatctgatagaagaaaaaaaaaccttcccttcaatgtaaaaccgaaactaacaagaaagaagcacagtgccgtttaggcaagtatggagtacgtattaagcatgtagaaggccatgcatgaaccactaacaagaaagaagcgcagtgccattcaggcaagcataagcatgtagattggcatgcatgaacaactaacagtagatcgtctctggtctgattagaagttttttgggaagccaagaaatcatgtacaactggttccatctcaaattccgtggcaaaaagaggcctaagcaacataaagcttcggtccgggcctagaaggccattgggtcatcggatcccgggcaactttattatacaaagttgatagatatctggtctaactaactagtcctaaggacccggcggaccgaagctggccgctctagaactagtggatctcgatgtgtagtctacgagaagggttaaccgtctcttcgtgagaataaccgtggcctaaaaataagccgatgaggataaataaaatgtggtggtacagtacttcaagaggtttactcatcaagaggatgcttttccgatgagctctagtagtacatcggacctcacatacctccattgtggtgaaatattttgtgctcatttagtgatgggtaaattttgtttatgtcactctaggttttgacatttcagttttgccactcttaggttttgacaaataatttccattccgcggcaaaagcaaaacaattttattttacttttaccactcttagctttcacaatgtatcacaaatgccactctagaaattctgtttatgccacagaatgtgaaaaaaaacactcacttatttgaagccaaggtgttcatggcatggaaatgtgacataaagtaacgttcgtgtataagaaaaaattgtactcctcgtaacaagagacggaaacatcatgagacaatcgcgtttggaaggctttgcatcacctttggatgatgcgcatgaatggagtcgtctgcttgctagccttcgcctaccgcccactgagtccgggcggcaactaccatcggcgaacgacccagctgacctctaccgaccggacttgaatgcgctaccttcgtcagcgacgatggccgcgtacgctggcgacgtgcccccgcatgcatggcggcacatggcgagctcagaccgtgcgtggctggctacaaatacgtaccccgtgagtgccctagctagaaacttacacctgcaactgcgagagcgagcgtgtgagtgtagccgagtagatcccccgggctgcaggtcgactctagaggatccaccggtcgccaccatggcccacagcaagcacggcctgaaggaggagatgaccatgaagtaccacatggagggctgcgtgaacggccacaagttcgtgatcaccggcgagggcatcggctaccccttcaagggcaagcagaccatcaacctgtgcgtgatcgagggcggccccctgcccttcagcgaggacatcctgagcgccggcttcaagtacggcgaccggatcttcaccgagtacccccaggacatcgtggactacttcaagaacagctgccccgccggctacacctggggccggagcttcctgttcgaggacggcgccgtgtgcatctgtaacgtggacatcaccgtgagcgtgaaggagaactgcatctaccacaagagcatcttcaacggcgtgaacttccccgccgacggccccgtgatgaagaagatgaccaccaactgggaggccagctgcgagaagatcatgcccgtgcctaagcagggcatcctgaagggcgacgtgagcatgtacctgctgctgaaggacggcggccggtaccggtgccagttcgacaccgtgtacaaggccaagagcgtgcccagcaagatgcccgagtggcacttcatccagcacaagctgctgcgggaggaccggagcgacgccaagaaccagaagtggcagctgaccgagcacgccatcgccttccccagcgccctggcctgaagcggcccatggatattcgaacgcgtaggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgccaccgcggtggagctcgaattccggtccgaagcttaagccatggcccgggaatcttagcggccgcctgcagagttaacggcgcgccgactagctagctaaggtaccgagctcgaattcattccgattaatcgtggcctcttgctcttcaggatgaagagctatgtttaaacgtgcaagcgctactagacaattcagtacattaaaaacgtccgcaatgtgttattaagttgtctaagcgtcaatttgtttacaccacaatatatcctgcca

SEQ ID NO: 72 - DNA, 20570 bp, Artificial sequence
  Synthetic construct
gtttacccgccaatatatcctgtcaaacactgatagtttaaactgaaggcgggaaacgacaatctgatcatgagcggagaattaagggagtcacgttatgacccccgccgatgacgcgggacaagccgttttacgtttggaactgacagaaccgcaacgttgaaggagccactcagcaagctggtacgattgtaatacgactcactatagggcgaattgagcgctgtttaaacgctcttcaactggaagagcggttacgctgtttaaacgctcttcaactggaagagcggttactaccggttcactagctagctgctaatcgagctagttaccctatgaggtgacatgaagcgctcacggttactatgacggttagcttcacgactgttggtggcagtagcgtacgacttagctatagttccggacttacccttaagataacttcgtatagcatacattatacgaagttatgggcccacgcgtgaagagcggttaccagagctggtcacctttgtccaccaagatggaactgtcttcggccagaatggcctccggaatttatcgctatcaactttgtatagaaaagttgggccgaattcgagctcggtacggccagaatggcccggaccgggttaccgaattcgagctcggtaccctgggatccggtgcgggcctcttcgctattacgccagctggcgaaagggggatgtgctgcaaggcgattaagttgggtaacgccagggttttcccagtcacgacgttgtaaaacgacggccagtgccaagctcagatcagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactctagaggatccaccggtcgccaccatggcaccgaagaagaagcgcaaggtgatggacaagaagtacagcatcggcctcgacatcggcaccaactcggtgggctgggccgtcatcacggacgaatataaggtcccgtcgaagaagttcaaggtcctcggcaatacagaccgccacagcatcaagaaaaacttgatcggcgccctcctgttcgatagcggcgagaccgcggaggcgaccaggctcaagaggaccgccaggagacggtacactaggcgcaagaacaggatctgctacctgcaggagatcttcagcaacgagatggcgaaggtggacgactccttcttccaccgcctggaggaatcattcctggtggaggaggacaagaagcatgagcggcacccaatcttcggcaacatcgtcgacgaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcaggtggcctaccacgagaagtacccgacaatctaccacctccggaagaaactggtggacagcacagacaaggcggacctccggctcatctaccttgccctcgcgcatatgatcaagttccgcggccacttcctcatcgagggcgacctgaacccggacaactccgacgtggacaagctgttcatccagctcgtgcagacgtacaatcaactgttcgaggagaaccccataaacgctagcggcgtggacgccaaggccatcctctcggccaggctctcgaaatcaagaaggctggagaaccttatcgcgcagttgccaggcgaaaagaagaacggcctcttcggcaaccttattgcgctcagcctcggcctgacgccgaacttcaaatcaaacttcgacctcgcggaggacgccaagctccagctctcaaaggacacctacgacgacgacctcgacaacctcctggcccagataggagaccagtacgcggacctcttcctcgccgccaagaacctctccgacgctatcctgctcagcgacatccttcgggtcaacaccgaaattaccaaggcaccgctgtccgccagcatgattaaacgctacgacgagcaccatcaggacctcacgctgctcaaggcactcgtccgccagcagctccccgagaagtacaaggagatcttcttcgaccaatcaaaaaacggctacgcgggatatatcgacggcggtgccagccaggaagagttctacaagttcatcaaaccaatcctggagaagatggacggcaccgaggagttgctggtcaagctcaacagggaggacctcctcaggaagcagaggaccttcgacaacggctccatcccgcatcagatccacctgggcgaactgcatgccatcctgcggcgccaggaggacttctacccgttcctgaaggataaccgggagaagatcgagaagatcttgacgttccgcatcccatactacgtgggcccgctggctcgcggcaactcccggttcgcctggatgacccggaagtcggaggagaccatcacaccctggaactttgaggaggtggtcgataagggcgctagcgctcagagcttcatcgagcgcatgaccaacttcgataaaaacctgcccaatgaaaaagtcctccccaagcactcgctgctctacgagtacttcaccgtgtacaacgagctcaccaaggtcaaatacgtcaccgagggcatgcggaagccggcgttcctgagcggcgagcagaagaaggcgatagtggacctcctcttcaagaccaacaggaaggtgaccgtgaagcaattaaaagaggactacttcaagaaaatagagtgcttcgactccgtggagatctcgggcgtggaggatcggttcaacgcctcactcggcacgtatcacgacctcctcaagatcattaaagacaaggacttcctcgacaacgaggagaacgaggacatcctcgaggacatcgtcctcaccctgaccctgttcgaggaccgcgaaatgatcgaggagaggctgaagacctacgcgcacctgttcgacgacaaggtcatgaaacagctcaagaggcgccgctacactggttggggaaggctgtcccgcaagctcattaatggcatcagggacaagcagagcggcaagaccatcctggacttcctcaagtccgacgggttcgccaaccgcaacttcatgcagctcattcacgacgactcgctcacgttcaaggaagacatccagaaggcacaggtgagcgggcagggtgactccctccacgaacacatcgccaacctggccggctcgccggccattaaaaagggcatcctgcagacggtcaaggtcgtcgacgagctcgtgaaggtgatgggccggcacaagcccgaaaatatcgtcatagagatggccagggagaaccagaccacccaaaaagggcagaagaactcgcgcgagcggatgaaacggatcgaggagggcattaaagagctcgggtcccagatcctgaaggagcaccccgtggaaaatacccagctccagaatgaaaagctctacctctactacctgcagaacggccgcgacatgtacgtggaccaggagctggacattaatcggctatcggactacgacgtcgaccacatcgtgccgcagtcgttcctcaaggacgatagcatcgacaacaaggtgctcacccggtcggataaaaatcggggcaagagcgacaacgtgcccagcgaggaggtcgtgaagaagatgaaaaactactggcgccagctcctcaacgcgaaactgatcacccagcgcaagttcgacaacctgacgaaggcggaacgcggtggcttgagcgaactcgataaggcgggcttcataaaaaggcagctggtcgagacgcgccagatcacgaagcatgtcgcccagatcctggacagccgcatgaatactaagtacgatgaaaacgacaagctgatccgggaggtgaaggtgatcacgctgaagtccaagctcgtgtcggacttccgcaaggacttccagttctacaaggtccgcgagatcaacaactaccaccacgcccacgacgcctacctgaatgcggtggtcgggaccgccctgatcaagaagtacccgaagctggagtcggagttcgtgtacggcgactacaaggtctacgacgtgcgcaaaatgatcgccaagtccgagcaggagatcggcaaggccacggcaaaatacttcttctactcgaacatcatgaacttcttcaagaccgagatcaccctcgcgaacggcgagatccgcaagcgcccgctcatcgaaaccaacggcgagacgggcgagatcgtctgggataagggccgggatttcgcgacggtccgcaaggtgctctccatgccgcaagtcaatatcgtgaaaaagacggaggtccagacgggcgggttcagcaaggagtccatcctcccgaagcgcaactccgacaagctcatcgcgaggaagaaggattgggacccgaaaaaatatggcggcttcgacagcccgaccgtcgcatacagcgtcctcgtcgtggcgaaggtggagaagggcaagtcaaagaagctcaagtccgtgaaggagctgctcgggatcacgattatggagcggtcctccttcgagaagaacccgatcgacttcctagaggccaagggatataaggaggtcaagaaggacctgattattaaactgccgaagtactcgctcttcgagctggaaaacggccgcaagaggatgctcgcctccgcaggcgagttgcagaagggcaacgagctcgccctcccgagcaaatacgtcaatttcctgtacctcgctagccactatgaaaagctcaagggcagcccggaggacaacgagcagaagcagctcttcgtggagcagcacaagcattacctggacgagatcatcgagcagatcagcgagttctcgaagcgggtgatcctcgccgacgcgaacctggacaaggtgctgtcggcatataacaagcaccgcgacaaaccaatacgcgagcaggccgaaaatatcatccacctcttcaccctcaccaacctcggcgctccggcagccttcaagtacttcgacaccacgattgaccggaagcggtacacgagcacgaaggaggtgctcgatgcgacgctgatccaccagagcatcacagggctctatgaaacacgcatcgacctgagccagctgggcggagacaagagaccacgggaccgccacgatggcgagctgggaggccgcaagcgggcaaggtaggtaccgttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaattcgtaatcatgtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgctgatccgatatcgatgggccctggccgaagcttggtcacccggtccgggcctagaaggccagcttcaagtttgtacaaaaaagcaggctccggccagaatggcccggaccgggttaccgaattcgagctcggtaccctgggatccgatatcgatgggccctggccgaagctttgagagtacaatgatgaacctagattaatcaatgccaaagtctgaaaaatgcaccctcagtctatgatccagaaaatcaagattgcttgaggccctgttcggttgttccggattagagccccggattaattcctagccggattacttctctaatttatatagattttgatgagctggaatgaatcctggcttattccggtacaaccgaacaggccctgaaggataccagtaatcgctgagctaaattggcatgctgtcagagtgtcagtattgcagcaaggtagtgagataaccggcatcatggtgccagtttgatggcaccattagggttagagatggtggccatgggcgcatgtcctggccaactttgtatgatatatggcagggtgaataggaaagtaaaattgtattgtaaaaagggatttcttctgtttgttagcgcatgtacaaggaatgcaagttttgagcgagggggcatcaaagatctggctgtgtttccagctgtttttgttagccccatcgaatccttgacataatgatcccgcttaaataagcaacctcgcttgtatagttccttgtgctctaacacacgatgatgataagtcgtaaaatagtggtgtccaaagaatttccaggcccagttgtaaaagctaaaatgctattcgaatttctactagcagtaagtcgtgtttagaaattatttttttatataccttttttccttctatgtacagtaggacacagtgtcagcgccgcgttgacggagaatatttgcaaaaaagtaaaagagaaagtcatagcggcgtatgtgccaaaaacttcgtcacagagagggccataagaaacatggcccacggcccaatacgaagcaccgcgacgaagcccaaacagcagtccgtaggtggagcaaagcgctgggtaatacgcaaacgttttgtcccaccttgactaatcacaagagtggagcgtaccttataaaccgagccgcaagcaccgaattgcatcatatctatccgtagccgttttagagctagaaatagcaagttaaaataaggctagtccgttatcaacttgaaaaagtggcaccgagtcggtgctttttttttgcggccgcgaattcctgcagggccctcttgtcggaccagttgcccaccacgttggtgaggggcacccagctttcttgtacaaagtggccgttaacggatcggccagaatggcccggaccgggttaccgaattcgagctcggtaccctgggatccgatatcgatgggccctggccgaagctttgagagtacaatgatgaacctagattaatcaatgccaaagtctgaaaaatgcaccctcagtctatgatccagaaaatcaagattgcttgaggccctgttcggttgttccggattagagccccggattaattcctagccggattacttctctaatttatatagattttgatgagctggaatgaatcctggcttattccggtacaaccgaacaggccctgaaggataccagtaatcgctgagctaaattggcatgctgtcagagtgtcagtattgcagcaaggtagtgagataaccggcatcatggtgccagtttgatggcaccattagggttagagatggtggccatgggcgcatgtcctggccaactttgtatgatatatggcagggtgaataggaaagtaaaattgtattgtaaaaagggatttcttctgtttgttagcgcatgtacaaggaatgcaagttttgagcgagggggcatcaaagatctggctgtgtttccagctgtttttgttagccccatcgaatccttgacataatgatcccgcttaaataagcaacctcgcttgtatagttccttgtgctctaacacacgatgatgataagtcgtaaaatagtggtgtccaaagaatttccaggcccagttgtaaaagctaaaatgctattcgaatttctactagcagtaagtcgtgtttagaaattatttttttatataccttttttccttctatgtacagtaggacacagtgtcagcgccgcgttgacggagaatatttgcaaaaaagtaaaagagaaagtcatagcggcgtatgtgccaaaaacttcgtcacagagagggccataagaaacatggcccacggcccaatacgaagcaccgcgacgaagcccaaacagcagtccgtaggtggagcaaagcgctgggtaatacgcaaacgttttgtcccaccttgactaatcacaagagtggagcgtaccttataaaccgagccgcaagcaccgaattgttacttctctaagcacggcgttttagagctagaaatagcaagttaaaataaggctagtccgttatcaacttgaaaaagtggcaccgagtcggtgctttttttttgcggccgcgaattcctgcagggccctcttgtcggaccagttgcccaccacgttggtgaggggcaactttattatacaaagttgatagataatacgcgtctatagtattttaaaattgcattaacaaacatgtcctaattggtactcctgagatactataccctcctgttttaaaatagttggcattatcgaattatcattttactttttaatgttttctcttcttttaatatattttatgaattttaatgtattttaaaatgttatgcagttcgctctggacttttctgctgcgcctacacttgggtgtactgggcctaaattcagcctgaccgaccgcctgcattgaataatggatgagcaccggtaaaatccgcgtacccaactttcgagaagaaccgagacgtggcgggccgggccaccgacgcacggcaccagcgactgcacacgtcccgccggcgtacgtgtacgtgctgttccctcactggccgcccaatccactcatgcatgcccacgtacacccctgccgtggcgcgcccagatcctaatcctttcgccgttctgcacttctgctgcctataaatggcggcatcgaccgtcacctgcttcaccaccggcgagccacatcgagaacacgatcgagcacacaagcacgaagactcgtttaggagaaaccacaaaccaccaagccgtgcaagcaccaggcttgggcacccgctccgggcttagaaggccagcttcaagtttgtacaaaaaagcaggcttcgaaggagatagaaccgatccaccatgtccaacctgctcacggttcaccagaaccttccggctcttccagtggacgcgacgtccgatgaagtcaggaagaacctcatggacatgttccgcgacaggcaagcgttcagcgagcacacctggaagatgctgctctccgtctgccgctcctgggctgcatggtgcaagctgaacaacaggaagtggttccccgctgagcccgaggacgtgagggattaccttctgtacctgcaagcgcgaggtttgtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgcctaggtctggcagtgaagaccatccagcaacaccttggacaactgaacatgcttcacaggcgctccggcctcccgcgccccagcgactcgaacgccgtgagcctcgtcatgcgccgcatcaggaaggaaaacgtcgatgccggcgaaagggcaaagcaggccctcgcgttcgagaggaccgatttcgaccaggtccgcagcctgatggagaacagcgacaggtgccaggacattaggaacctggcgttcctcggaattgcatacaacacgctcctcaggatcgcggaaattgcccgcattcgcgtgaaggacattagccgcaccgacggcggcaggatgcttatccacattggcaggaccaagacgctcgtttccaccgcaggcgtcgaaaaggccctcagcctcggagtgaccaagctcgtcgaacgctggatctccgtgtccggcgtcgcggacgacccaaacaactacctcttctgccgcgtccgcaagaacggggtggctgcccctagcgccaccagccaactcagcacgagggccttggaaggtattttcgaggccacccaccgcctgatctacggcgcgaaggatgacagcggtcaacgctacctcgcatggtccgggcactccgcccgcgttggagctgctagggacatggcccgcgccggtgtttccatccccgaaatcatgcaggcgggtggatggacgaacgtgaacattgtcatgaactacattcgcaaccttgacagcgagacgggcgcaatggttcgcctcctggaagatggtgactgagctagacccagctttcttgtacaaagtggccgttaacggatccagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgccaccgcggcctaaggggtcaccggcctagaaggccatttaaatcagatatctggttcctaaggacccggcggaccgattaaactgattcggtccgacgcgttacctaataacttcgtatagcatacattatacgaagttattagctaactaactagtaagcttaagccatgggtcgacggatccgttaactcacttaagatgtactcgacaatggtgccctcataccggcatgtgtttcctagaaataatcaatatattgattgagatttatctcgatatatttctgaactatgttcatcatataaataactgaaaacatcaaatcgtaattttaaactcatgcttggtcaatacatagataatacaatattacttcatcatcccaatgatgtcctagcacaacctattgaatgttaatgtttggttgtgtgggggtgtgtttataacatagatgtgattatttgtgctttttgttgagtatatacatatatggtatgttgatttgatatagtgatggacacatgctttggccttggatattcaaatcacttgtacttgcacgaagcaaaacataatataagtttagaagtaaacttgtaactgtgtccaaacatgctcacacaaagtcatatcgcattatatttttttggtaaatattcaacacatgtattttttacaagaacccaaattttacagacaaatgcagcattgtagacatgtagaattctttgaagcatgtgaacttaacaacactaatgtcattaaatcaactggaccctatgagtaacaatttcgatattgcaaacaccaaattatggaacttatttgctgaaaaaattatgatcaatgtgaagtttaaattattataccataaatatatcaaagattttttttgaggaaggtaaaaattgcatggaatgggctgcccaacgtgatagctcacttttatgctaggtagcattaccaaagatgggaatgttctgatgaacaccaaacccactcaaataatatttatatttgggttgtttagttgtaaaagtgaagacccaagattaaagtaccaattgtcgatgccatacactagaagtgaagaatgttgttagcgttaggagtagatgtgtcaatggggaccgatactcgttatcgatgggccgcacgtaagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactctagaggatccaccatggttgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgatgatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaggatccaccatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcgaccttcttatgtgcttctagtctccaaatgtggttgatagttattttgctctaagatcaacagtaatgaagtataaatcatcgttgtggtgtgctactcggttaattgagcattaacacacacaaacatgacgaggatggtataatctccaaaaatgtgtactttgttaggtgggaccctatagccttgattaatgtgctatgttaggcatgcctggaaacgtgtgacgcatatgttttgtgaacctgttgatattatatgtgcttttatattaccatattttattaaaatactaatatttattactagtaagatataacattctatctagcttaaaaactaaccataaatattccataataactagatttaccaaactaatatactaaatatacataataaatacaaaattaacaagacaataatcaatatttatgagcttaatatatttagacattatggttggtcgacgataatcatgctaacttttcgtaattgcttgattgaaatatgcttagaataatgcctctttgttctacatggcaaatagggaccattatggtgtaacaccctgggaaccacaaacaccccgaaatgctactaaactacacaactaaccttcatatataaaatttcgacagcatctcctttgaaaatttgcatagacgtggaagcaacagagtataaacagatatcatgataagaaaacatactagacattaataatctgctagaaatgggaagaatcctaacttgacgactgcgtaactgactagagtcacacttagctgaccctagtcacttacaactgacttcgtgtcctagggcgatccgatatcgatgggccctggccgaagcttggtcacccggtccgggcctagaaggccagcttcggccgccccaattcccatggagtcaaagattcaaatagaggacctaacagaactcgccgtaaagactggcgaacagttcatacagagtctcttacgactcaatgacaagaagaaaatcttcgtcaacatggtggagcacgacacgcttgtctactccaaaaatatcaaagatacagtctcagaagaccaaagggcaattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactaagctgaccgaagctggccgctctagaactagtggatctcgatgtgtagtctacgagaagggttaaccgtctcttcgtgagaataaccgtggcctaaaaataagccgatgaggataaataaaatgtggtggtacagtacttcaagaggtttactcatcaagaggatgcttttccgatgagctctagtagtacatcggacctcacatacctccattgtggtgaaatattttgtgctcatttagtgatgggtaaattttgtttatgtcactctaggttttgacatttcagttttgccactcttaggttttgacaaataatttccattccgcggcaaaagcaaaacaattttattttacttttaccactcttagctttcacaatgtatcacaaatgccactctagaaattctgtttatgccacagaatgtgaaaaaaaacactcacttatttgaagccaaggtgttcatggcatggaaatgtgacataaagtaacgttcgtgtataagaaaaaattgtactcctcgtaacaagagacggaaacatcatgagacaatcgcgtttggaaggctttgcatcacctttggatgatgcgcatgaatggagtcgtctgcttgctagccttcgcctaccgcccactgagtccgggcggcaactaccatcggcgaacgacccagctgacctctaccgaccggacttgaatgcgctaccttcgtcagcgacgatggccgcgtacgctggcgacgtgcccccgcatgcatggcggcacatggcgagctcagaccgtgcgtggctggctacaaatacgtaccccgtgagtgccctagctagaaacttacacctgcaactgcgagagcgagcgtgtgagtgtagccgagtagatcccccgggctgcaggtcgactctagaggatccaccggtcgccaccatggccctgtccaacaagttcatcggcgacgacatgaagatgacctaccacatggacggctgcgtgaacggccactacttcaccgtgaagggcgagggcagcggcaagccctacgagggcacccagacctccaccttcaaggtgaccatggccaacggcggccccctggccttctccttcgacatcctgtccaccgtgttcatgtacggcaaccgctgcttcaccgcctaccccaccagcatgcccgactacttcaagcaggccttccccgacggcatgtcctacgagagaaccttcacctacgaggacggcggcgtggccaccgccagctgggagatcagcctgaagggcaactgcttcgagcacaagtccaccttccacggcgtgaacttccccgccgacggccccgtgatggccaagaagaccaccggctgggacccctccttcgagaagatgaccgtgtgcgacggcatcttgaagggcgacgtgaccgccttcctgatgctgcagggcggcggcaactacagatgccagttccacacctcctacaagaccaagaagcccgtgaccatgccccccaaccacgtggtggagcaccgcatcgccagaaccgacctggacaagggcggcaacagcgtgcagctgaccgagcacgccgtggcccacatcacctccgtggtgcccttctgaagcggcccatggatattcgaacgcgtcgctgaaatcaccagtctctctctacaaatctatctctctctataataatgtgtgagtagttcccagataagggaattagggttcttatagggtttcgctcatgtgttgagcatataagaaacccttagtatgtatttgtatttgtaaaatacttctatcaataaaatttctaattcctaaaaccaaaatccagtggcgagctcgagccagggtgcttcctgagctgattccgatgacttcgtaggttcctagctcaagccgctcgtgtccaagcgtcacttacgattagctaatgattacggcatctaggaccgactagctaactaactagtacgccgactagctagctaaggtaccgagctcgaattcattccgattaatcgtggcctcttgctcttcaggatgaagagctatgtttaaacgtgcaagcgctactagacaattcagtacattaaaaacgtccgcaatgtgttattaagttgtctaagcgtcaatttgtttacaccacaatatatcctgcca

SEQ ID NO: 73 - DNA, 20572 bp, Artificial sequence
  Synthetic construct
gtttacccgccaatatatcctgtcaaacactgatagtttaaactgaaggcgggaaacgacaatctgatcatgagcggagaattaagggagtcacgttatgacccccgccgatgacgcgggacaagccgttttacgtttggaactgacagaaccgcaacgttgaaggagccactcagcaagctggtacgattgtaatacgactcactatagggcgaattgagcgctgtttaaacgctcttcaactggaagagcggttacgctgtttaaacgctcttcaactggaagagcggttactaccggttcactagctagctgctaatcgagctagttaccctatgaggtgacatgaagcgctcacggttactatgacggttagcttcacgactgttggtggcagtagcgtacgacttagctatagttccggacttacccttaagataacttcgtatagcatacattatacgaagttatgggcccacgcgtgaagagcggttaccagagctggtcacctttgtccaccaagatggaactgtcttcggccagaatggcctccggaatttatcgctatcaactttgtatagaaaagttgggccgaattcgagctcggtacggccagaatggcccggaccgggttaccgaattcgagctcggtaccctgggatccggtgcgggcctcttcgctattacgccagctggcgaaagggggatgtgctgcaaggcgattaagttgggtaacgccagggttttcccagtcacgacgttgtaaaacgacggccagtgccaagctcagatcagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactctagaggatccaccggtcgccaccatggcaccgaagaagaagcgcaaggtgatggacaagaagtacagcatcggcctcgacatcggcaccaactcggtgggctgggccgtcatcacggacgaatataaggtcccgtcgaagaagttcaaggtcctcggcaatacagaccgccacagcatcaagaaaaacttgatcggcgccctcctgttcgatagcggcgagaccgcggaggcgaccaggctcaagaggaccgccaggagacggtacactaggcgcaagaacaggatctgctacctgcaggagatcttcagcaacgagatggcgaaggtggacgactccttcttccaccgcctggaggaatcattcctggtggaggaggacaagaagcatgagcggcacccaatcttcggcaacatcgtcgacgaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcaggtggcctaccacgagaagtacccgacaatctaccacctccggaagaaactggtggacagcacagacaaggcggacctccggctcatctaccttgccctcgcgcatatgatcaagttccgcggccacttcctcatcgagggcgacctgaacccggacaactccgacgtggacaagctgttcatccagctcgtgcagacgtacaatcaactgttcgaggagaaccccataaacgctagcggcgtggacgccaaggccatcctctcggccaggctctcgaaatcaagaaggctggagaaccttatcgcgcagttgccaggcgaaaagaagaacggcctcttcggcaaccttattgcgctcagcctcggcctgacgccgaacttcaaatcaaacttcgacctcgcggaggacgccaagctccagctctcaaaggacacctacgacgacgacctcgacaacctcctggcccagataggagaccagtacgcggacctcttcctcgccgccaagaacctctccgacgctatcctgctcagcgacatccttcgggtcaacaccgaaattaccaaggcaccgctgtccgccagcatgattaaacgctacgacgagcaccatcaggacctcacgctgctcaaggcactcgtccgccagcagctccccgagaagtacaaggagatcttcttcgaccaatcaaaaaacggctacgcgggatatatcgacggcggtgccagccaggaagagttctacaagttcatcaaaccaatcctggagaagatggacggcaccgaggagttgctggtcaagctcaacagggaggacctcctcaggaagcagaggaccttcgacaacggctccatcccgcatcagatccacctgggcgaactgcatgccatcctgcggcgccaggaggacttctacccgttcctgaaggataaccgggagaagatcgagaagatcttgacgttccgcatcccatactacgtgggcccgctggctcgcggcaactcccggttcgcctggatgacccggaagtcggaggagaccatcacaccctggaactttgaggaggtggtcgataagggcgctagcgctcagagcttcatcgagcgcatgaccaacttcgataaaaacctgcccaatgaaaaagtcctccccaagcactcgctgctctacgagtacttcaccgtgtacaacgagctcaccaaggtcaaatacgtcaccgagggcatgcggaagccggcgttcctgagcggcgagcagaagaaggcgatagtggacctcctcttcaagaccaacaggaaggtgaccgtgaagcaattaaaagaggactacttcaagaaaatagagtgcttcgactccgtggagatctcgggcgtggaggatcggttcaacgcctcactcggcacgtatcacgacctcctcaagatcattaaagacaaggacttcctcgacaacgaggagaacgaggacatcctcgaggacatcgtcctcaccctgaccctgttcgaggaccgcgaaatgatcgaggagaggctgaagacctacgcgcacctgttcgacgacaaggtcatgaaacagctcaagaggcgccgctacactggttggggaaggctgtcccgcaagctcattaatggcatcagggacaagcagagcggcaagaccatcctggacttcctcaagtccgacgggttcgccaaccgcaacttcatgcagctcattcacgacgactcgctcacgttcaaggaagacatccagaaggcacaggtgagcgggcagggtgactccctccacgaacacatcgccaacctggccggctcgccggccattaaaaagggcatcctgcagacggtcaaggtcgtcgacgagctcgtgaaggtgatgggccggcacaagcccgaaaatatcgtcatagagatggccagggagaaccagaccacccaaaaagggcagaagaactcgcgcgagcggatgaaacggatcgaggagggcattaaagagctcgggtcccagatcctgaaggagcaccccgtggaaaatacccagctccagaatgaaaagctctacctctactacctgcagaacggccgcgacatgtacgtggaccaggagctggacattaatcggctatcggactacgacgtcgaccacatcgtgccgcagtcgttcctcaaggacgatagcatcgacaacaaggtgctcacccggtcggataaaaatcggggcaagagcgacaacgtgcccagcgaggaggtcgtgaagaagatgaaaaactactggcgccagctcctcaacgcgaaactgatcacccagcgcaagttcgacaacctgacgaaggcggaacgcggtggcttgagcgaactcgataaggcgggcttcataaaaaggcagctggtcgagacgcgccagatcacgaagcatgtcgcccagatcctggacagccgcatgaatactaagtacgatgaaaacgacaagctgatccgggaggtgaaggtgatcacgctgaagtccaagctcgtgtcggacttccgcaaggacttccagttctacaaggtccgcgagatcaacaactaccaccacgcccacgacgcctacctgaatgcggtggtcgggaccgccctgatcaagaagtacccgaagctggagtcggagttcgtgtacggcgactacaaggtctacgacgtgcgcaaaatgatcgccaagtccgagcaggagatcggcaaggccacggcaaaatacttcttctactcgaacatcatgaacttcttcaagaccgagatcaccctcgcgaacggcgagatccgcaagcgcccgctcatcgaaaccaacggcgagacgggcgagatcgtctgggataagggccgggatttcgcgacggtccgcaaggtgctctccatgccgcaagtcaatatcgtgaaaaagacggaggtccagacgggcgggttcagcaaggagtccatcctcccgaagcgcaactccgacaagctcatcgcgaggaagaaggattgggacccgaaaaaatatggcggcttcgacagcccgaccgtcgcatacagcgtcctcgtcgtggcgaaggtggagaagggcaagtcaaagaagctcaagtccgtgaaggagctgctcgggatcacgattatggagcggtcctccttcgagaagaacccgatcgacttcctagaggccaagggatataaggaggtcaagaaggacctgattattaaactgccgaagtactcgctcttcgagctggaaaacggccgcaagaggatgctcgcctccgcaggcgagttgcagaagggcaacgagctcgccctcccgagcaaatacgtcaatttcctgtacctcgctagccactatgaaaagctcaagggcagcccggaggacaacgagcagaagcagctcttcgtggagcagcacaagcattacctggacgagatcatcgagcagatcagcgagttctcgaagcgggtgatcctcgccgacgcgaacctggacaaggtgctgtcggcatataacaagcaccgcgacaaaccaatacgcgagcaggccgaaaatatcatccacctcttcaccctcaccaacctcggcgctccggcagccttcaagtacttcgacaccacgattgaccggaagcggtacacgagcacgaaggaggtgctcgatgcgacgctgatccaccagagcatcacagggctctatgaaacacgcatcgacctgagccagctgggcggagacaagagaccacgggaccgccacgatggcgagctgggaggccgcaagcgggcaaggtaggtaccgttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaattcgtaatcatgtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgctgatccgatatcgatgggccctggccgaagcttggtcacccggtccgggcctagaaggccagcttcaagtttgtacaaaaaagcaggctccggccagaatggcccggaccgggttaccgaattcgagctcggtaccctgggatccgatatcgatgggccctggccgaagctttgagagtacaatgatgaacctagattaatcaatgccaaagtctgaaaaatgcaccctcagtctatgatccagaaaatcaagattgcttgaggccctgttcggttgttccggattagagccccggattaattcctagccggattacttctctaatttatatagattttgatgagctggaatgaatcctggcttattccggtacaaccgaacaggccctgaaggataccagtaatcgctgagctaaattggcatgctgtcagagtgtcagtattgcagcaaggtagtgagataaccggcatcatggtgccagtttgatggcaccattagggttagagatggtggccatgggcgcatgtcctggccaactttgtatgatatatggcagggtgaataggaaagtaaaattgtattgtaaaaagggatttcttctgtttgttagcgcatgtacaaggaatgcaagttttgagcgagggggcatcaaagatctggctgtgtttccagctgtttttgttagccccatcgaatccttgacataatgatcccgcttaaataagcaacctcgcttgtatagttccttgtgctctaacacacgatgatgataagtcgtaaaatagtggtgtccaaagaatttccaggcccagttgtaaaagctaaaatgctattcgaatttctactagcagtaagtcgtgtttagaaattatttttttatataccttttttccttctatgtacagtaggacacagtgtcagcgccgcgttgacggagaatatttgcaaaaaagtaaaagagaaagtcatagcggcgtatgtgccaaaaacttcgtcacagagagggccataagaaacatggcccacggcccaatacgaagcaccgcgacgaagcccaaacagcagtccgtaggtggagcaaagcgctgggtaatacgcaaacgttttgtcccaccttgactaatcacaagagtggagcgtaccttataaaccgagccgcaagcaccgaattgctccagctgctctaatcgatggttttagagctagaaatagcaagttaaaataaggctagtccgttatcaacttgaaaaagtggcaccgagtcggtgctttttttttgcggccgcgaattcctgcagggccctcttgtcggaccagttgcccaccacgttggtgaggggcacccagctttcttgtacaaagtggccgttaacggatcggccagaatggcccggaccgggttaccgaattcgagctcggtaccctgggatccgatatcgatgggccctggccgaagctttgagagtacaatgatgaacctagattaatcaatgccaaagtctgaaaaatgcaccctcagtctatgatccagaaaatcaagattgcttgaggccctgttcggttgttccggattagagccccggattaattcctagccggattacttctctaatttatatagattttgatgagctggaatgaatcctggcttattccggtacaaccgaacaggccctgaaggataccagtaatcgctgagctaaattggcatgctgtcagagtgtcagtattgcagcaaggtagtgagataaccggcatcatggtgccagtttgatggcaccattagggttagagatggtggccatgggcgcatgtcctggccaactttgtatgatatatggcagggtgaataggaaagtaaaattgtattgtaaaaagggatttcttctgtttgttagcgcatgtacaaggaatgcaagttttgagcgagggggcatcaaagatctggctgtgtttccagctgtttttgttagccccatcgaatccttgacataatgatcccgcttaaataagcaacctcgcttgtatagttccttgtgctctaacacacgatgatgataagtcgtaaaatagtggtgtccaaagaatttccaggcccagttgtaaaagctaaaatgctattcgaatttctactagcagtaagtcgtgtttagaaattatttttttatataccttttttccttctatgtacagtaggacacagtgtcagcgccgcgttgacggagaatatttgcaaaaaagtaaaagagaaagtcatagcggcgtatgtgccaaaaacttcgtcacagagagggccataagaaacatggcccacggcccaatacgaagcaccgcgacgaagcccaaacagcagtccgtaggtggagcaaagcgctgggtaatacgcaaacgttttgtcccaccttgactaatcacaagagtggagcgtaccttataaaccgagccgcaagcaccgaattgcgtggtccttggctgccttggttttagagctagaaatagcaagttaaaataaggctagtccgttatcaacttgaaaaagtggcaccgagtcggtgctttttttttgcggccgcgaattcctgcagggccctcttgtcggaccagttgcccaccacgttggtgaggggcaactttattatacaaagttgatagataatacgcgtctatagtattttaaaattgcattaacaaacatgtcctaattggtactcctgagatactataccctcctgttttaaaatagttggcattatcgaattatcattttactttttaatgttttctcttcttttaatatattttatgaattttaatgtattttaaaatgttatgcagttcgctctggacttttctgctgcgcctacacttgggtgtactgggcctaaattcagcctgaccgaccgcctgcattgaataatggatgagcaccggtaaaatccgcgtacccaactttcgagaagaaccgagacgtggcgggccgggccaccgacgcacggcaccagcgactgcacacgtcccgccggcgtacgtgtacgtgctgttccctcactggccgcccaatccactcatgcatgcccacgtacacccctgccgtggcgcgcccagatcctaatcctttcgccgttctgcacttctgctgcctataaatggcggcatcgaccgtcacctgcttcaccaccggcgagccacatcgagaacacgatcgagcacacaagcacgaagactcgtttaggagaaaccacaaaccaccaagccgtgcaagcaccaggcttgggcacccgctccgggcttagaaggccagcttcaagtttgtacaaaaaagcaggcttcgaaggagatagaaccgatccaccatgtccaacctgctcacggttcaccagaaccttccggctcttccagtggacgcgacgtccgatgaagtcaggaagaacctcatggacatgttccgcgacaggcaagcgttcagcgagcacacctggaagatgctgctctccgtctgccgctcctgggctgcatggtgcaagctgaacaacaggaagtggttccccgctgagcccgaggacgtgagggattaccttctgtacctgcaagcgcgaggtttgtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgcctaggtctggcagtgaagaccatccagcaacaccttggacaactgaacatgcttcacaggcgctccggcctcccgcgccccagcgactcgaacgccgtgagcctcgtcatgcgccgcatcaggaaggaaaacgtcgatgccggcgaaagggcaaagcaggccctcgcgttcgagaggaccgatttcgaccaggtccgcagcctgatggagaacagcgacaggtgccaggacattaggaacctggcgttcctcggaattgcatacaacacgctcctcaggatcgcggaaattgcccgcattcgcgtgaaggacattagccgcaccgacggcggcaggatgcttatccacattggcaggaccaagacgctcgtttccaccgcaggcgtcgaaaaggccctcagcctcggagtgaccaagctcgtcgaacgctggatctccgtgtccggcgtcgcggacgacccaaacaactacctcttctgccgcgtccgcaagaacggggtggctgcccctagcgccaccagccaactcagcacgagggccttggaaggtattttcgaggccacccaccgcctgatctacggcgcgaaggatgacagcggtcaacgctacctcgcatggtccgggcactccgcccgcgttggagctgctagggacatggcccgcgccggtgtttccatccccgaaatcatgcaggcgggtggatggacgaacgtgaacattgtcatgaactacattcgcaaccttgacagcgagacgggcgcaatggttcgcctcctggaagatggtgactgagctagacccagctttcttgtacaaagtggccgttaacggatccagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgccaccgcggcctaaggggtcaccggcctagaaggccatttaaatcagatatctggttcctaaggacccggcggaccgattaaactgattcggtccgacgcgttacctaataacttcgtatagcatacattatacgaagttattagctaactaactagtaagcttaagccatgggtcgacggatccgttaactcacttaagatgtactcgacaatggtgccctcataccggcatgtgtttcctagaaataatcaatatattgattgagatttatctcgatatatttctgaactatgttcatcatataaataactgaaaacatcaaatcgtaattttaaactcatgcttggtcaatacatagataatacaatattacttcatcatcccaatgatgtcctagcacaacctattgaatgttaatgtttggttgtgtgggggtgtgtttataacatagatgtgattatttgtgctttttgttgagtatatacatatatggtatgttgatttgatatagtgatggacacatgctttggccttggatattcaaatcacttgtacttgcacgaagcaaaacataatataagtttagaagtaaacttgtaactgtgtccaaacatgctcacacaaagtcatatcgcattatatttttttggtaaatattcaacacatgtattttttacaagaacccaaattttacagacaaatgcagcattgtagacatgtagaattctttgaagcatgtgaacttaacaacactaatgtcattaaatcaactggaccctatgagtaacaatttcgatattgcaaacaccaaattatggaacttatttgctgaaaaaattatgatcaatgtgaagtttaaattattataccataaatatatcaaagattttttttgaggaaggtaaaaattgcatggaatgggctgcccaacgtgatagctcacttttatgctaggtagcattaccaaagatgggaatgttctgatgaacaccaaacccactcaaataatatttatatttgggttgtttagttgtaaaagtgaagacccaagattaaagtaccaattgtcgatgccatacactagaagtgaagaatgttgttagcgttaggagtagatgtgtcaatggggaccgatactcgttatcgatgggccgcacgtaagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactctagaggatccaccatggttgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgatgatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaggatccaccatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcgaccttcttatgtgcttctagtctccaaatgtggttgatagttattttgctctaagatcaacagtaatgaagtataaatcatcgttgtggtgtgctactcggttaattgagcattaacacacacaaacatgacgaggatggtataatctccaaaaatgtgtactttgttaggtgggaccctatagccttgattaatgtgctatgttaggcatgcctggaaacgtgtgacgcatatgttttgtgaacctgttgatattatatgtgcttttatattaccatattttattaaaatactaatatttattactagtaagatataacattctatctagcttaaaaactaaccataaatattccataataactagatttaccaaactaatatactaaatatacataataaatacaaaattaacaagacaataatcaatatttatgagcttaatatatttagacattatggttggtcgacgataatcatgctaacttttcgtaattgcttgattgaaatatgcttagaataatgcctctttgttctacatggcaaatagggaccattatggtgtaacaccctgggaaccacaaacaccccgaaatgctactaaactacacaactaaccttcatatataaaatttcgacagcatctcctttgaaaatttgcatagacgtggaagcaacagagtataaacagatatcatgataagaaaacatactagacattaataatctgctagaaatgggaagaatcctaacttgacgactgcgtaactgactagagtcacacttagctgaccctagtcacttacaactgacttcgtgtcctagggcgatccgatatcgatgggccctggccgaagcttggtcacccggtccgggcctagaaggccagcttcggccgccccaattcccatggagtcaaagattcaaatagaggacctaacagaactcgccgtaaagactggcgaacagttcatacagagtctcttacgactcaatgacaagaagaaaatcttcgtcaacatggtggagcacgacacgcttgtctactccaaaaatatcaaagatacagtctcagaagaccaaagggcaattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactaagctgaccgaagctggccgctctagaactagtggatctcgatgtgtagtctacgagaagggttaaccgtctcttcgtgagaataaccgtggcctaaaaataagccgatgaggataaataaaatgtggtggtacagtacttcaagaggtttactcatcaagaggatgcttttccgatgagctctagtagtacatcggacctcacatacctccattgtggtgaaatattttgtgctcatttagtgatgggtaaattttgtttatgtcactctaggttttgacatttcagttttgccactcttaggttttgacaaataatttccattccgcggcaaaagcaaaacaattttattttacttttaccactcttagctttcacaatgtatcacaaatgccactctagaaattctgtttatgccacagaatgtgaaaaaaaacactcacttatttgaagccaaggtgttcatggcatggaaatgtgacataaagtaacgttcgtgtataagaaaaaattgtactcctcgtaacaagagacggaaacatcatgagacaatcgcgtttggaaggctttgcatcacctttggatgatgcgcatgaatggagtcgtctgcttgctagccttcgcctaccgcccactgagtccgggcggcaactaccatcggcgaacgacccagctgacctctaccgaccggacttgaatgcgctaccttcgtcagcgacgatggccgcgtacgctggcgacgtgcccccgcatgcatggcggcacatggcgagctcagaccgtgcgtggctggctacaaatacgtaccccgtgagtgccctagctagaaacttacacctgcaactgcgagagcgagcgtgtgagtgtagccgagtagatcccccgggctgcaggtcgactctagaggatccaccggtcgccaccatggccctgtccaacaagttcatcggcgacgacatgaagatgacctaccacatggacggctgcgtgaacggccactacttcaccgtgaagggcgagggcagcggcaagccctacgagggcacccagacctccaccttcaaggtgaccatggccaacggcggccccctggccttctccttcgacatcctgtccaccgtgttcatgtacggcaaccgctgcttcaccgcctaccccaccagcatgcccgactacttcaagcaggccttccccgacggcatgtcctacgagagaaccttcacctacgaggacggcggcgtggccaccgccagctgggagatcagcctgaagggcaactgcttcgagcacaagtccaccttccacggcgtgaacttccccgccgacggccccgtgatggccaagaagaccaccggctgggacccctccttcgagaagatgaccgtgtgcgacggcatcttgaagggcgacgtgaccgccttcctgatgctgcagggcggcggcaactacagatgccagttccacacctcctacaagaccaagaagcccgtgaccatgccccccaaccacgtggtggagcaccgcatcgccagaaccgacctggacaagggcggcaacagcgtgcagctgaccgagcacgccgtggcccacatcacctccgtggtgcccttctgaagcggcccatggatattcgaacgcgtcgctgaaatcaccagtctctctctacaaatctatctctctctataataatgtgtgagtagttcccagataagggaattagggttcttatagggtttcgctcatgtgttgagcatataagaaacccttagtatgtatttgtatttgtaaaatacttctatcaataaaatttctaattcctaaaaccaaaatccagtggcgagctcgagccagggtgcttcctgagctgattccgatgacttcgtaggttcctagctcaagccgctcgtgtccaagcgtcacttacgattagctaatgattacggcatctaggaccgactagctaactaactagtacgccgactagctagctaaggtaccgagctcgaattcattccgattaatcgtggcctcttgctcttcaggatgaagagctatgtttaaacgtgcaagcgctactagacaattcagtacattaaaaacgtccgcaatgtgttattaagttgtctaagcgtcaatttgtttacaccacaatatatcctgcca

SEQ ID NO: 74 - DNA, 26187 bp, Artificial sequence
  Synthetic construct
gtttacccgccaatatatcctgtcaaacactgatagtttaaactgaaggcgggaaacgacaatctgatcatgagcctagttagttaggggcagctaacgtcccctagctaactagttgctattaacctttagcctagtttagtgcggtcgcgctagtgaactagtctaatgggtgcctagcttagattagatccccgttcggcttagactaggttagtcggatagggctagtctagtggcttagcttggaactgttaagctaggctgttagtgcgggacttctaggctaacctattgacccctaacgcctagaacctaagaaacgctaaggacacctagctaactttggcgacgtccagaggtccgattccggctaactaactagcttaagcttgatatcgaattcctgcagcccatccctcagccgcctttcactatcttttttgcccgagtcattgtcatgtgaaccttggcatgtataatcggtgaattgcgtcgattttcctcttataggtgggccaatgaatccgtgtgatcgcgtctgattggctagagatatgtttcttccttgttggatgtattttcatacataatcatatgcatacaaatatttcattacactttatagaaatggtcagtaataaaccctatcactatgtctggtgtttcattttatttgcttttaaacgaaaattgacttcctgattcaatatttaaggatcgtcaacggtgtgcagttactaaattctggtttgtaggaactatagtaaactattcaagtcttcacttattgtgcactcacctctcgccacatcaccacagatgttattcacgtcttaaatttgaactacacatcatattgacacaatattttttttaaataagcgattaaaacctagcctctatgtcaacaatggtgtacataaccagcgaagtttagggagtaaaaaacatcgccttacacaaagttcgctttaaaaaataaagagtaaattttactttggaccacccttcaaccaatgtttcactttagaacgagtaattttattattgtcactttggaccaccctcaaatcttttttccatctacatccaatttatcatgtcaaagaaatggtctacatacagctaaggagatttatcgacgaatagtagctagcatactcgaggtcattcatatgcttgagaagagagtcgggatagtccaaaataaaacaaaggtaagattacctggtcaaaagtgaaaacatcagttaaaaggtggtataaagtaaaatatcggtaataaaaggtggcccaaagtgaaatttactcttttctactattataaaaattgaggatgtttttgtcggtactttgatacgtcatttttgtatgaattggtttttaagtttattcgcttttggaaatgcatatctgtatttgagtcgggttttaagttcgtttgcttttgtaaatacagagggatttgtataagaaatatctttaaaaaaacccatatgctaatttgacataatttttgaaaaaaatatatattcaggcgaattctcacaatgaacaataataagattaaaatagctttcccccgttgcagcgcatgggtattttttctagtaaaaataaaagataaacttagactcaaaacatttacaaaaacaacccctaaagttcctaaagcccaaagtgctatccacgatccatagcaagcccagcccaacccaacccaacccaacccaccccagtccagccaactggacaatagtctccacacccccccactatcaccgtgagttgtccgcacgcaccgcacgtctcgcagccaaaaaaaaaaaaagaaagaaaaaaaagaaaaagaaaaaacagcaggtgggtccgggtcgtgggggccggaaacgcgaggaggatcgcgagccagcgacgaggccggccctccctccgcttccaaagaaacgccccccatcgccactatatacatacccccccctctcctcccatccccccaaccctaccaccaccaccaccaccacctccacctcctcccccctcgctgccggacgacgagctcctcccccctccccctccgccgccgccgcgccggtaaccaccccgcccctctcctctttctttctccgttttttttttccgtcacggtctcgatctttggccttggtagtttgggtgggcgagaggcggcttcgtgcgcgcccagatcggtgcgcgggaggggcgggatctcgcggctggggctctcgccggcgtggatcaggcccggatctcgcggggaatggggctctcggatgtagatctgcgatccgccgttgttgggggagatgatggggggtttaaaatttccgccatgctaaacaagatcaggaagaggggaaaagggcactatggtttatatttttatatatttctgctgcttcgtcaggcttagatgtgctagatctttctttcttctttttgtgggtagaatttgaatccctcagcattgttcatcggtagtttttcttttcatgatttgtgacaaatgcagcctcgtgcggagcttttttgtaggtagaaggatccatggcggccaatgcgggcggcggtggagcgggaggaggcagcggcagcggcagcgtggctgcgccggcggtgtgccgccccagcggctcgcggtggacgccgacgccggagcagatcaggatgctgaaggagctctactacggctgcggcatccggtcgcccagctcggagcagatccagcgcatcaccgccatgctgcggcagcacggcaagatcgagggcaagaacgtcttctactggttccagaaccacaaggcccgcgagcgccagaagcgccgcctcaccagcctcgacgtcaacgtgcccgccgccggcgcggccgacgccaccaccagccaactcggcgtcctctcgctgtcgtcgccgccgccttcaggcgcggcgcctccctcgcccaccctcggcttctacgccgccggcaatggcggcggatcggctgtgctgctggacacgagttccgactggggcagcagcggcgctgctatggccaccgagacatgcttcctgcaggactacatgggcgtgacggacacgggcagctcgtcgcagtggccacgcttctcgtcgtcggacacgataatggcggcggccgcggcgcgggcggcgacgacgcgggcgcccgagacgctccctctcttcccgacctgcggcgacgacggcggcagcggtagcagcagctacttgccgttctggggtgccgcgtccacaactgccggcgccacttcttccgttgcgatccaacagcaacaccagctgcaggagcagtacagcttttacagcaacagcaacagcacccagctggccggcaccggcaaccaagacgtatcggcaacagcagcagcagccgccgccctggagctgagcctcagctcatggtgctccccttaccctgctgcagggagtatgtgaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcggcgatcgcggtaccatttaaattgcgcccgccacggccgtggaggtcgtattccggtcagcttgcatccctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactctagaggatccatggccactgtgaacaactggctcgctttctccctctccccgcaggagctgccgccctcccagacgacggactccacactcatctcggccgccaccgccgaccatgtctccggcgatgtctgcttcaacatcccccaagattggagcatgaggggatcagagctttcggcgctcgtcgcggagccgaagctggaggacttcctcggcggcatctccttctccgagcagcatcacaaggccaactgcaacatgatacccagcactagcagcacagtttgctacgcgagctcaggtgctagcaccggctaccatcaccagctgtaccaccagcccaccagctcagcgctccacttcgcggactccgtaatggtggcttcctcggccggtgtccacgacggcggtgccatgctcagcgcggccgccgctaacggtgtcgctggcgctgccagtgccaacggcggcggcatcgggctgtccatgattaagaactggctgcggagccaaccggcgcccatgcagccgagggtggcggcggctgagggcgcgcaggggctctctttgtccatgaacatggcggggacgacccaaggcgctgctggcatgccacttctcgctggagagcgcgcacgggcgcccgagagtgtatcgacgtcagcacagggtggagccgtcgtcgtcacggcgccgaaggaggatagcggtggcagcggtgttgccggcgctctagtagccgtgagcacggacacgggtggcagcggcggcgcgtcggctgacaacacggcaaggaagacggtggacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggaaggatgtctgcatgggggactgtcgtgtctgcagccgcggcggcagcagcaagcagcaacgacaacatggccgccgacgtcgggcatggcggcgcgcagctcttcagtgtctggaacgacacttaaggcgtacgtgccggcctggctctccgaaagggcgtattccagcacactggcggccgttactagacccaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggcctccggattcttatgtgcttctagtctccaaatgtggttgatagttattttgctctaagatcaacagtaatgaagtataaatcatcgttgtggtgtgctactcggttaattgagcattaacacacacaaacatgacgaggatggtataatctccaaaaatgtgtactttgttaggtgggaccctatagccttgattaatgtgctatgttaggcatgcctggaaacgtgtgacgcatatgttttgtgaacctgttgatattatatgtgcttttatattaccatattttattaaaatactaatatttattactagtaagatataacattctatctagcttaaaaactaaccataaatattccataataactagatttaccaaactaatatactaaatatacataataaatacaaaattaacaagacaataatcaatatttatgagcttaatatatttagacattatggttggtcgacgataatcatgctaacttttcgtaattgcttgattgaaatatgcttagaataatgcctctttgttctacatggcaaatagggaccattatggtgtaacaccctgggaaccacaaacaccccgaaatgctactaaactacacaactaaccttcatatataaaatttcgacagcatctcctttgaaaatttgcatagacgtggaagcaacagagtataaacagatatcatgataagaaaacatactagacattaataatctgctagaaatgggaagaatcacgcgtaagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactttaacttagcctaggatccaacaatgccccagttcgacatcctctgcaagaccccccccaaggtgctcgtgaggcagttcgtggagaggttcgagaggccctccggcgagaagatcgccctctgcgccgccgagctcacctacctctgctggatgatcacccacaacggcaccgccattaagagggccaccttcatgtcatacaacaccatcatctccaactccctctccttcgacatcgtgaacaagtccctccagttcaaatacaagacccagaaggccaccatcctcgaggcctccctcaagaagctcatccccgcctgggagttcaccatcatcccctactacggccagaagcaccagtccgacatcaccgacatcgtgtcatccctccagcttcagttcgagtcctccgaggaggctgacaagggcaactcccactccaagaagatgctgaaggccctcctctccgagggcgagtccatctgggagatcaccgagaagatcctcaactccttcgagtacacctccaggttcactaagaccaagaccctctaccagttcctcttcctcgccaccttcatcaactgcggcaggttctcagacatcaagaacgtggaccccaagtccttcaagctcgtgcagaacaagtacctaggtttgtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgcctaggtgtcatcatccagtgcctcgtgaccgagaccaagacctccgtgtccaggcacatctacttcttctccgctcgcggcaggatcgaccccctcgtgtacctcgacgagttcctcaggaactcagagcccgtgctcaagagggtgaacaggaccggcaactcctcctccaacaagcaggagtaccagctcctcaaggacaacctcgtgaggtcctacaacaaggccctcaagaagaacgccccctactccatcttcgccatcaagaacggccccaagtcccacatcggtaggcacctcatgacctccttcctctcaatgaagggcctcaccgagctcaccaacgtggtgggcaactggtccgacaagagggcctccgccgtggccaggaccacctacacccaccagatcaccgccatccccgaccactacttcgccctcgtgtcaaggtactacgcctacgaccccatctccaaggagatgatcgccctcaaggacgagactaaccccatcgaggagtggcagcacatcgagcagctcaagggctccgccgagggctccatcaggtaccccgcctggaacggcatcatctcccaggaggtgctcgactacctctcctcctacatcaacaggaggatctgagttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcggtcacaccggttaaaaccaaaatccagtggcgagctctcgagtcgatcgctatcaactttgtatagaaaagttgggccgaattcgagctcggtacggccagaatggcccggaccgggttaccgaattcgagctcggtaccctgggatcagcttcgctgaaatcaccagtctctctctacaaatctatctctctctataataatgtgtgagtagttcccagataagggaattagggttcttatagggtttcgctcatgtgttgagcatataagaaacccttagtatgtatttgtatttgtaaaatacttctatcaataaaatttctaattcctaaaaccaaaatccagtggcgagctgctagcgaagttcctattccgaagttcctattctctagaaagtataggaacttcagatccaccgggatccccgatcatgcaaaaactcattaactcagtgcaaaactatgcctggggcagcaaaacggcgttgactgaactttatggtatggaaaatccgtccagccagccgatggccgagctgtggatgggcgcacatccgaaaagcagttcacgagtgcagaatgccgccggagatatcgtttcactgcgtgatgtgattgagagtgataaatcgactctgctcggagaggccgttgccaaacgctttggcgaactgcctttcctgttcaaagtattatgcgcagcacagccactctccattcaggttcatccaaacaaacacaattctgaaatcggttttgccaaagaaaatgccgcaggtatcccgatggatgccgccgagcgtaactataaagatcctaaccacaagccggagctggtttttgcgctgacgcctttccttgcgatgaacgcgtttcgtgaattttccgagattgtctccctactccagccggtcgcaggtgcacatccggcgattgctcactttttacaacagcctgatgccgaacgtttaagcgaactgttcgccagcctgttgaatatgcagggtgaagaaaaatcccgcgcgctggcgattttaaaatcggccctcgatagccagcagggtgaaccgtggcaaacgattcgtttaatttctgaattttacccggaagacagcggtctgttctccccgctattgctgaatgtggtgaaattgaaccctggcgaagcgatgttcctgttcgctgaaacaccgcacgcttacctgcaaggcgtggcgctggaagtgatggcaaactccgataacgtgctgcgtgcgggtctgacgcctaaatacattgatattccggaactggttgccaatgtgaaattcgaagccaaaccggctaaccagttgttgacccagccggtgaaacaaggtgcagaactggacttcccgattccagtggatgattttgccttctcgctgcatgaccttagtgataaagaaaccaccattagccagcagagtgccgccattttgttctgcgtcgaaggcgatgcaacgttgtggaaaggttctcagcagttacagcttaaaccgggtgaatcagcgtttattgccgccaacgaatcaccggtgactgtcaaaggccacggccgtttagcgcgtgtttacaacaagctgtaagagcttactgaaaaaattaacatctcttgctaagctgggggtggaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcgaccttcttatgtgcttctagtctccaaatgtggttgatagttattttgctctaagatcaacagtaatgaagtataaatcatcgttgtggtgtgctactcggttaattgagcattaacacacacaaacatgacgaggatggtataatctccaaaaatgtgtactttgttaggtgggaccctatagccttgattaatgtgctatgttaggcatgcctggaaacgtgtgacgcatatgttttgtgaacctgttgatattatatgtgcttttatattaccatattttattaaaatactaatatttattactagtaagatataacattctatctagcttaaaaactaaccataaatattccataataactagatttaccaaactaatatactaaatatacataataaatacaaaattaacaagacaataatcaatatttatgagcttaatatatttagacattatggttggtcgacgataatcatgctaacttttcgtaattgcttgattgaaatatgcttagaataatgcctctttgttctacatggcaaatagggaccattatggtgtaacaccctgggaaccacaaacaccccgaaatgctactaaactacacaactaaccttcatatataaaatttcgacagcatctcctttgaaaatttgcatagacgtggaagcaacagagtataaacagatatcatgataagaaaacatactagacattaataatctgctagaaatgggaagaatcctaacttgacgactgcgtaactgactagagtcacacttagctgaccctagtcacttacaactgacttcgtgtcctaggcttaggctactgctagtccgcggtgtatccgtgatcgagttggcgccagacggaatctgttctccatcgctgacatcctcgagtagatcacattcaagcttgatatcgaattcctgcagcccatccctcagccgcctttcactatcttttttgcccgagtcattgtcatgtgaaccttggcatgtataatcggtgaattgcgtcgattttcctcttataggtgggccaatgaatccgtgtgatcgcgtctgattggctagagatatgtttcttccttgttggatgtattttcatacataatcatatgcatacaaatatttcattacactttatagaaatggtcagtaataaaccctatcactatgtctggtgtttcattttatttgcttttaaacgaaaattgacttcctgattcaatatttaaggatcgtcaacggtgtgcagttactaaattctggtttgtaggaactatagtaaactattcaagtcttcacttattgtgcactcacctctcgccacatcaccacagatgttattcacgtcttaaatttgaactacacatcatattgacacaatattttttttaaataagcgattaaaacctagcctctatgtcaacaatggtgtacataaccagcgaagtttagggagtaaaaaacatcgccttacacaaagttcgctttaaaaaataaagagtaaattttactttggaccacccttcaaccaatgtttcactttagaacgagtaattttattattgtcactttggaccaccctcaaatcttttttccatctacatccaatttatcatgtcaaagaaatggtctacatacagctaaggagatttatcgacgaatagtagctagcatactcgaggtcattcatatgcttgagaagagagtcgggatagtccaaaataaaacaaaggtaagattacctggtcaaaagtgaaaacatcagttaaaaggtggtataaagtaaaatatcggtaataaaaggtggcccaaagtgaaatttactcttttctactattataaaaattgaggatgtttttgtcggtactttgatacgtcatttttgtatgaattggtttttaagtttattcgcttttggaaatgcatatctgtatttgagtcgggttttaagttcgtttgcttttgtaaatacagagggatttgtataagaaatatctttaaaaaaacccatatgctaatttgacataatttttgagaaaaatatatattcaggcgaattctcacaatgaacaataataagattaaaatagctttcccccgttgcagcgcatgggtattttttctagtaaaaataaaagataaacttagactcaaaacatttacaaaaacaacccctaaagttcctaaagcccaaagtgctatccacgatccatagcaagcccagcccaacccaacccaacccaacccaccccagtccagccaactggacaatagtctccacacccccccactatcaccgtgagttgtccgcacgcaccgcacgtctcgcagccaaaaaaaaaaaaagaaagaaaaaaaagaaaaagaaaaaacagcaggtgggtccgggtcgtgggggccggaaacgcgaggaggatcgcgagccagcgacgaggccggccctccctccgcttccaaagaaacgccccccatcgccactatatacatacccccccctctcctcccatccccccaaccctaccaccaccaccaccaccacctccacctcctcccccctcgctgccggacgacgagctcctcccccctccccctccgccgccgccgcgccggtaaccaccccgcccctctcctctttctttctccgttttttttttccgtcacggtctcgatctttggccttggtagtttgggtgggcgagaggcggcttcgtgcgcgcccagatcggtgcgcgggaggggcgggatctcgcggctggggctctcgccggcgtggatcaggcccggatctcgcggggaatggggctctcggatgtagatctgcgatccgccgttgttgggggagatgatggggggtttaaaatttccgccatgctaaacaagatcaggaagaggggaaaagggcactatggtttatatttttatatatttctgctgcttcgtcaggcttagatgtgctagatctttctttcttctttttgtgggtagaatttgaatccctcagcattgttcatcggtagtttttcttttcatgatttgtgacaaatgcagcctcgtgcggagcttttttgtaggtagaaggatccacacgacaccatgtcccccgagcgccgccccgtcgagatccgcccggccaccgccgccgacatggccgccgtgtgcgacatcgtgaaccactacatcgagacctccaccgtgaacttccgcaccgagccgcagaccccgcaggagtggatcgacgacctggagcgcctccaggaccgctacccgtggctcgtggccgaggtggagggcgtggtggccggcatcgcctacgccggcccgtggaaggcccgcaacgcctacgactggaccgtggagtccaccgtgtacgtgtcccaccgccaccagcgcctcggcctcggctccaccctctacacccacctcctcaagagcatggaggcccagggcttcaagtccgtggtggccgtgatcggcctcccgaacgacccgtccgtgcgcctccacgaggccctcggctacaccgcccgcggcaccctgcgcgccgccggctacaagcacggcggctggcacgacgtcggcttctggcagcgcgacttcgagctgccggccccgccgcgcccggtgcgcccggtgacgcagatctgagtcgacctgcaggcatgccgctgaaatcaccagtctctctctacaaatctatctctctctataataatgtgtgagtagttcccagataagggaattagggttcttatagggtttcgctcatgtgttgagcatataagaaacccttagtatgtatttgtatttgtaaaatacttctatcaataaaatttctaattcctaaaaccaaaatccagtggcgagctaatgcggcccgaataacttcgtatagcatacattatacgaagttatacctggtggcgccgctaggggctgcaggaattcctgcagcccgggggatccactagttctagagcggccgacctcgacagatctaagcttactagtgccgtgggtcgtttaagctgccgctgtacctgtgtcgtctggtgccttctggtgtacctgggaggttgtcgtctatcaagtatctgtggttggtgtcatgagtcagtgagtcccaatactgttcgtgtcctgtgtgcattatacccaaaactgttatgggcaaatcatgaataagcttgatgttcgaacttaaaagtctctgctcaatatggtattatggttgtttttgttcgtctcctaatatttgcctgggatcaaattttattggctggtgttcatttgacctccatgttcttgctaggctccattttttactctacagccataatatgtttgattgtttggtttgttctttgttgtacacctggttctgtcgagcttagttttcgacactggcttacagcttaacatgttgctattttattgggttctgattgctattttattgggttctgattgctagtttttgctgaatccaaaaaccatgttatttatttaagcgatccaggttattattatgatggtggctaagtttttttttttccaagggtaaattttctggattctccagtgtttctgtggccgaattcactagtgattcagatctgatatcgatgggcccactaactatctatactgtaataatgttgtatagccgccggatagctagctagtttagtcattcagcggcgatgggtaataataaagtgtcatccatccatcaccatgggtggcaacgtgagcaatgacctgattgaacaaattgaaatgaaaagaagaaatatgttatatgtcaacgagatttcctcataatgccactgacgacgtgtgtccaagaaatgtatcagtgatacgtatattcacaatttttttatgacttatactcacaatttgtttttttactacttatactcacaatttgttgtgggtaccataacaatttcgatcgaatatatatcagaaagttgacgaaagtaagctcactcaaaaagttaaatgggctgcggaagctgcgtcaggcccaagttttggctattctatccggtatccacgattttgatggctgagggacatatgttcgcttaagcttggtcacccggtccgggcctagaaggccagcttcaagtttgtacaaaaaagcaggctccggccagaatggcccggaccgggtgaccggcgcgccaagcttggtgacggcgacgcgatcgaacaggtggtgatcgatgctgcaacgtgtgtaaatatacagcgccggctgggtcaagagatggctcgggtgacgcgcgcgcggcgtgtcctggcgttggcgccggggcattctttagtttttcatcttttcatcatctcagatggtagatacaaaacagtgtatgtatgtagctctgtttctctctatagaaccccaacaaattttgttgttgatgttgtttatcttcatatgctttgatcttgaaatcgtctaccttactactgccgatcgttgctcaaaagtgtggaagtttgaagcatcttccacgggcgttgctctactcccatctcgtttcaccacgaaatccccttcgcatagaggcatctcagccgtacatctccaaacccacgttctggattcagcaaacggacggcatatgccagcggactgactaggatttgtggttcagaataaaaatatggtttgcagtgtcaattttccaggagagtgactatgtcatactaacttcatactccaataatgaagctaagctatctccatgtacatatcaaatacgaaatcatatccaagggaactaacacagtcacaaacaacaggtacacagacaattacagcacaagcgcaggagggaaataattttaactgaactaggaagaaaggaaacacaactcattttttattgatatatgttggatgaatccaataaaaccgatacaagtcacgaaaaatcagactagatgaatccttcgagatcacatgagcaaaacctttcgacgaaagctgtcctatagtcgtggaagcaataacacttgataaagataggaattcagacacgagaggttgcagactataagatgtcaggtacctacgcgttcgaatcaatgagatgatgcagtagaggtagagcgaagagggaaggctgagatcgacgcatcactgccatgtccctgatgatgatgaggtagcaatggagatctacagagcgggcaattgaagttgagatgttgaagccagccttccaaacactgcttatggaagacgtgtctgcaatctagcttcctcacttcttctccggtcttgagtttagacagacacacgatgcagtcagaggctgcgttgtcggagtagcggtacgagaagaggcgatttaggttgagctggtcggcgaggacgctgaggtttgaagtaacaacaacaacgggggcagaagaagggaagaggagaagagaccggacgtgtctgaagaaagttgcgaggagagccagtagcatcagtgggatcgaatctgatgacacgtcggagagctgaccttgtagtcccatggatcctaggctaagttaaagtcgacctgcagaagtaacaccaaacaacagggtgagcatcgacaaaagaaacagtaccaagcaaataaatagcgtatgaaggcagggctaaaaaaatccacatatagctgctgcatatgccatcatccaagtatatcaagatcaaaataattataaaacatacttgtttattataatagataggtactcaaggttagagcatatgaatagatgctgcatatgccatcatgtatatgcatcagtaaaacccacatcaacatgtatacctatcctagatcgatatttccatccatcttaaactcgtaactatgaagatgtatgacacacacatacagttccaaaattaataaatacaccaggtagtttgaaacagtattctactccgatctagaacgaatgaacgaccgcccaaccacaccacatcatcacaaccaagcgaacaaaaagcatctctgtatatgcatcagtaaaacccgcatcaacatgtatacctatcctagatcgatatttccatccatcatcttcaattcgtaactatgaatatgtatggcacacacatacagatccaaaattaataaatccaccaggtagtttgaaacagaattctactccgatctagaacgaccgcccaaccagaccacatcatcacaaccaagacaaaaaaaagcatgaaaagatgacccgacaaacaagtgcacggcatatattgaaataaaggaaaagggcaaaccaaaccctatgcaacgaaacaaaaaaaatcatgaaatcgatcccgtctgcggaacggctagagccatcccaggattccccaaagagaaacactggcaagttagcaatcagaacgtgtctgacgtacaggtcgcatccgtgtacgaacgctagcagcacggatctaacacaaacacggatctaacacaaacatgaacagaagtagaactaccgggccctaaccatgcatggaccggaacgccgatctagagaaggtagagaggggggggggggaggacgagcggcgtaccttgaagcggaggtgccgacgggtggatttgggggagatcctcgctttcctggaggaggcgtggagcgcacgcggttggaggcgaaggcggatgaaaaacgagaggggctgacgggctgtcttctgtctggcttgcgcccctccgacgggttggttggctttataggcgtgtggtgcatataattaggtgcgcgaaccgccgttccgatggaaaaaactggctatggaggctctcgattcgtgccggcctatcgagacggagctttttttattatttattttcatctcgcatgtatgttgtttgttcgctgatggaatttctgtttgttcgcgctgaaaacattggacagggttcgtttatgctgtgcccagtgaggaaccataaaaggaacgctgtgcatatggagtcacgtacttagtaaaaaatccttcgctctggattaaactaggttgattatactgttgcacgtagtatctatagagacaaaaatattataaaaatagtagaaaccgatacaaattaaagttaagtaaacatgatgtttatctgatactctaagtcaagcaagtcatttctagtgttttcttctgtgctactagcagagcaagagattgggacccgaggcgggggccatgcagacatagggggatgctccttaggagagagataaaaataaataatagaatatatgattattggtatagagtacagatttaaggtaaatattgcttcaaaagattgtggaatagagtagagaatctcgttgacaaaaatgaaatattacttttagaataaaaatttagagttgcataagtatagatatcattagtttggattgagggctagagctattccagctatttaggctctgtttataatcctacagccaataattaccagaagcttcggtccgggcctagaaggccgatctcccgggcacccagctttcttgtacaaagtggccgttaacggatcggccagaatggcccggaccgggttaccgaattgctaactaactaggagctccctttaatctggcgcttgatctgcatccgcggcttgcaaagataaatggcacatttagtgtgttattttgcaatacctttcatagtagatatccttaaatgcagttttaggcatgtttgggtaattaaataacatttttaggaggagttttagatttacctttctttcgtgatgactgatgacagacgtggggaattcaaatgcaactctagcgaaagttcatatatttttcataaatagctgaggctggggtaattattttttgtagaaaaatagaataggtggaatggtttggggaaggcgtaggcgctcgtggacgacgccccataaaagacaagaggcggaattgccatgaattcgaggtagctaagtaaggcgcatatatatgccaaaaattctactgtcactttccaatttcaatgcgctgccaaacaagccgccgacccttggatactgacttgaattcagcccaattctgtagatccaaacagggccggcgtcagtgcctcaggtgagagagcagcagacgatgcaaagagccaaaagtggaagcagacgcagccgaagccgaagcccaagcccaaaactgttttgtctttgcccagaaccgcgacgagcctaaactgccgcttcctcctatctacaagtccctggcacatcacgcatagtccaaccatcgcgcgcaggcgataaggcgcgccacggggacgcgacatgtggtggcggacgcgatcaggatagggccaggctggccgggcgcggccacgggagaacggtggccactcgtcccacatccgcttcgtcctgtcctgtactgcgtcctgcccccaacgagagccggagccggccatcccgtcgcacactctccccctctatatatgccgtcggtgtgggggagcctactacaggacgacccaagcaagcaagcaagcagcgagtacatacatactaggcagccaggcagccatgatgctgcactgcacatttgctatatctgaggctcctgcgcgcgccttggcccttggccaggtgtctgtcatgcgggcgatgccgcaggaagaagaagccgcggtggctacgacgaccatggccgggggcaaggtggcggcgctgctggccacggcggccgcgctgctgctgctgctcccgctggcgctgccgccgctgccgccgccgcccacgcagctgttgttcgtccccgtggtcttgctgctcctcgtggcgtccctcgcgttctgccccgccgcgacctcctcgccgtcgccgatgcatgccgccgaccacgggtcgttcgggaccactggatcaccgcacctatgttgaggtacccggggatcctctagtgccgtgggtcgtttaagctgccgctgtacctgtgtcgtctggtgccttctggtgtacctgggaggttgtcgtctatcaagtatctgtggttggtgtcatgagtcagtgagtcccaatactgttcgtgtcctgtgtgcattatacccaaaactgttatgggcaaatcatgaataagcttgatgttcgaacttaaaagtctctgctcaatatggtattatggttgtttttgttcgtctcctaatatttgcctgggatcaaattttattggctggtgttcatttgacctccatgttcttgctaggctccattttttactctacagccataatatgtttgattgtttggtttgttctttgttgtacacctggttctgtcgagcttagttttcgacactggcttacagcttaacatgttgctattttattgggttctgattgctattttattgggttctgattgctagtttttgctgaatccaaaaaccatgttatttatttaagcgatccaggttattattatgatggtggctaagtttttttttttccaagggtaaattttctggattctccagtgtttctgtggccgaattcaatcactagagtcgacctgcaggcatgcccgcggtggagctcgaattccggtccgggcctagaaggccagcttcggccgccccgggcaactttattatacaaagttgatagatcgagcgactaattaactagctgtcccacggcctaactagcacttaatcccctagcctaacctaagagcgctaatctaggctagtggtcacttagggctttaaggctagcgtatacgaagttcctattccgaagttcctattctccagaaagtataggaacttctgtacacctgagcctaactaactaggacgtcccgaggtccgattccgggctaattaacacctagctcgccactcgactaattagggactaagcctagcgcttagccgttaaaacctagcacaccctaagcacccttagttaggttcccctcttaattaagccctagtgagcccctaagttaaggggacgctaagagccccctaacctagtattcggctagaggcgaactaggctaaacacctaagcgcacctctttaagctagatcgctagggggctaggctagagcttcgctagattagtctaagggcagctaactaactaggtttaaactacattaaaaacgtccgcaatgtgttattaagttgtctaagcgtcaatttgtttacaccacaatatatcctgcca

SEQ ID NO: 75 - DNA, 9982 bp, Artificial sequence
  Synthetic construct
gtttacccgccaatatatcctgtcaaacactgatagtttaaactgaaggcgggaaacgacaatctgatcatgagcggagaattaagggagtcacgttatgacccccgccgatgacgcgggacaagccgttttacgtttggaactgacagaaccgcaacgttgaaggagccactcagcaagctggtacgattgtaatacgactcactatagggcgaattgagcgctgtttaaacgctcttcaactggaagagcggttactaccggttcactagctagctgctaaggttaccagagctggtcacctttgtccaccaacttattaagtatctagttgaagacacgttcttcttcacgtaagaagacactcagtagtcttcggccagaatggcctcttgattcagcgggcctagaaggccggatcactgactagctaatttaaatcctgaggatatcgctatcaactttgtatagaaaagttgaagcttcgctgaaatcaccagtctctctctacaaatctatctctctctataataatgtgtgagtagttcccagataagggaattagggttcttatagggtttcgctcatgtgttgagcatataagaaacccttagtatgtatttgtatttgtaaaatacttctatcaataaaatttctaattcctaaaaccaaaatccagtggcgagctgctagcgaagttcctattccgaagttcctattctctagaaagtataggaacttcagatcctagaggatcgatccccgatcatgcaaaaactcattaactcagtgcaaaactatgcctggggcagcaaaacggcgttgactgaactttatggtatggaaaatccgtccagccagccgatggccgagctgtggatgggcgcacatccgaaaagcagttcacgagtgcagaatgccgccggagatatcgtttcactgcgtgatgtgattgagagtgataaatcgactctgctcggagaggccgttgccaaacgctttggcgaactgcctttcctgttcaaagtattatgcgcagcacagccactctccattcaggttcatccaaacaaacacaattctgaaatcggttttgccaaagaaaatgccgcaggtatcccgatggatgccgccgagcgtaactataaagatcctaaccacaagccggagctggtttttgcgctgacgcctttccttgcgatgaacgcgtttcgtgaattttccgagattgtctccctactccagccggtcgcaggtgcacatccggcgattgctcactttttacaacagcctgatgccgaacgtttaagcgaactgttcgccagcctgttgaatatgcagggtgaagaaaaatcccgcgcgctggcgattttaaaatcggccctcgatagccagcagggtgaaccgtggcaaacgattcgtttaatttctgaattttacccggaagacagcggtctgttctccccgctattgctgaatgtggtgaaattgaaccctggcgaagcgatgttcctgttcgctgaaacaccgcacgcttacctgcaaggcgtggcgctggaagtgatggcaaactccgataacgtgctgcgtgcgggtctgacgcctaaatacattgatattccggaactggttgccaatgtgaaattcgaagccaaaccggctaaccagttgttgacccagccggtgaaacaaggtgcagaactggacttcccgattccagtggatgattttgccttctcgctgcatgaccttagtgataaagaaaccaccattagccagcagagtgccgccattttgttctgcgtcgaaggcgatgcaacgttgtggaaaggttctcagcagttacagcttaaaccgggtgaatcagcgtttattgccgccaacgaatcaccggtgactgtcaaaggccacggccgtttagcgcgtgtttacaacaagctgtaagagcttactgaaaaaattaacatctcttgctaagatccatgcatggatattcgaacgcgtaggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaattgcggccgggtaccgagctcgaattcggcccaagtttgtacaaaaaagcaggctccggccagagttacccggaccgaagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactctagaggatccaccggtcgccaccatggcctcctccgagaacgtcatcaccgagttcatgcgcttcaaggtgcgcatggagggcaccgtgaacggccacgagttcgagatcgagggcgagggcgagggccgcccctacgagggccacaacaccgtgaagctgaaggtgaccaagggcggccccctgcccttcgcctgggacatcctgtccccccagttccagtacggctccaaggtgtacgtgaagcaccccgccgacatccccgactacaagaagctgtccttccccgagggcttcaagtgggagcgcgtgatgaacttcgaggacggcggcgtggcgaccgtgacccaggactcctccctgcaggacggctgcttcatctacaaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcaggtgaagttcatcggcgtgaacttcccctccgacggccccgtgatgcagaagaagaccatgggctgggaggcctccaccgagcgcctgtacccccgcgacggcgtgctgaagggcgagacccacaaggccctgaagctgaaggacggcggccactacctggtggagttcaagtccatctacatggccaagaagcccgtgcagctgcccggctactactacgtggacgccaagctggacatcacctcccacaacgaggactacaccatcgtggagcagtacgagcgcaccgagggccgccaccacctgttcctgtagcggccgaagctaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgccaccgcggtggagctcgaattccggtccgggtcacccggtccgggcctagaaggccgatctcccgggcacccagctttcttgtacaaagtggccgttaacggatcccggtgaagttcctattccgaagttcctattctccagaaagtataggaacttcactagagcttgcggccgccccggagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcacggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactctagaggatccaacaatgccccagttcgacatcctctgcaagaccccccccaaggtgctcgtgaggcagttcgtggagaggttcgagaggccctccggcgagaagatcgccctctgcgccgccgagctcacctacctctgctggatgatcacccacaacggcaccgccattaagagggccaccttcatgtcatacaacaccatcatctccaactccctctccttcgacatcgtgaacaagtccctccagttcaaatacaagacccagaaggccaccatcctcgaggcctccctcaagaagctcatccccgcctgggagttcaccatcatcccctactacggccagaagcaccagtccgacatcaccgacatcgtgtcatccctccagcttcagttcgagtcctccgaggaggctgacaagggcaactcccactccaagaagatgctgaaggccctcctctccgagggcgagtccatctgggagatcaccgagaagatcctcaactccttcgagtacacctccaggttcactaagaccaagaccctctaccagttcctcttcctcgccaccttcatcaactgcggcaggttctcagacatcaagaacgtggaccccaagtccttcaagctcgtgcagaacaagtacctaggtttgtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgcctaggtgtcatcatccagtgcctcgtgaccgagaccaagacctccgtgtccaggcacatctacttcttctccgctcgcggcaggatcgaccccctcgtgtacctcgacgagttcctcaggaactcagagcccgtgctcaagagggtgaacaggaccggcaactcctcctccaacaagcaggagtaccagctcctcaaggacaacctcgtgaggtcctacaacaaggccctcaagaagaacgccccctactccatcttcgccatcaagaacggccccaagtcccacatcggtaggcacctcatgacctccttcctctcaatgaagggcctcaccgagctcaccaacgtggtgggcaactggtccgacaagagggcctccgccgtggccaggaccacctacacccaccagatcaccgccatccccgaccactacttcgccctcgtgtcaaggtactacgcctacgaccccatctccaaggagatgatcgccctcaaggacgagactaaccccatcgaggagtggcagcacatcgagcagctcaagggctccgccgagggctccatcaggtaccccgcctggaacggcatcatctcccaggaggtgctcgactacctctcctcctacatcaacaggaggatctgagttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaattgcggccccgggcaactttattatacaaagttgatagatatctggtctaactaactagtcctaaggacccggcggaccgattaaactgattcggtccgaagcttaagccatggcccgggaatcttagcggccgcctgcagagttaacggcgcgccgactagctagctaaggtaccgagctcgaattcattccgattaatcgtggcctcttgctcttcaggatgaagagctatgtttaaacgtgcaagcgctactagacaattcagtacattaaaaacgtccgcaatgtgttattaagttgtctaagcgtcaatttgtttacaccacaatatatcctgccac

SEQ ID NO: 76 - DNA, 10955 bp, Artificial sequence
  Synthetic construct
gtttacccgccaatatatcctgtcaaacactgatagtttaaactgaaggcgggaaacgacaatctgatcatgagcggagaattaagggagtcacgttatgacccccgccgatgacgcgggacaagccgttttacgtttggaactgacagaaccgcaacgttgaaggagccactcagcaagctggtacgattgtaatacgactcactatagggcgaattgagcgctgtttaaacgctcttcaactggaagagcggttaccagagctggtcacctttgtccaccaagatggaactgcggccgtaagtgactagggtcacgtgaccctagtcacttatcgagctagttaccctatgaggtgacatgaagcgctcacggttactatgacggttagcttcacgactgttggtggcagtagcgtacgacttagctatagttccggacttaccgggcccaccggtggtaccgagctcgtttaaacgctcttcaactggaagagcggttaccagagctggtcacctttgtccaccaagatggaactggcgcgcctcattaattaagtcagcggccgctctagttgaagacacgttcatgtcttcatcgtaagaagacactcagtagtcttcggccagaatggccatctggattcagcaggcctagaaggccatttaaatcctgaggatctggtcttcctaaggacccgggatatcggaccgattaaactttaattcggtccgacctggtggcgccgctagcgtatacgaagttcctattccgaagttcctattctccagaaagtataggaacttctgtacaataacttcgtatagcatacattatacgaagttatatgcatacgcgtcttaagtcgatcgctatcaactttgtatagaaaagttgggccgaattcgagctcggtacggccagaatggcccggaccgggttaccgaattcgagctcggtaccctgggatccgatatcgatgggccctggccgaagcttggtcacccggtccgggcctagaaggccagcttcaagtttgtacaaaaaagcaggctccggccagaatggcccggaccggaattcgagctcggatccactagtaacggccgccagtgtgctggaattcgcccttgacggcccgggctggtatttcaaaactatagtattttaaaattgcattaacaaacatgtcctaattggtactcctgagatactataccctcctgttttaaaatagttggcattatcgaattatcattttactttttaatgttttctcttcttttaatatattttatgaattttaatgtattttaaaatgttatgcagttcgctctggacttttctgctgcgcctacacttgggtgtactgggcctaaattcagcctgaccgaccgcctgcattgaataatggatgagcaccggtaaaatccgcgtacccaactttcgagaagaaccgagacgtggcgggccgggccaccgacgcacggcaccagcgactgcacacgtcccgccggcgtacgtgtacgtgctgttccctcactggccgcccaatccactcatgcatgcccacgtacacccctgccgtggcgcgcccagatcctaatcctttcgccgttctgcacttctgctgcctataaatggcggcatcgaccgtcacctgcttcaccaccggcgagccacatcgagaacacgatcgagcacacaagcacgaagactcgtttaggagaaaccacaaaccaccaagccgtgcaagcaccaagcttggtcacccggtccgggcctagaaggccagcttcaagtttgtacaaaaaagcaggcttcgaaggagatagaaccgatccaccatgtccaacctgctcacggttcaccagaaccttccggctcttccagtggacgcgacgtccgatgaagtcaggaagaacctcatggacatgttccgcgacaggcaagcgttcagcgagcacacctggaagatgctgctctccgtctgccgctcctgggctgcatggtgcaagctgaacaacaggaagtggttccccgctgagcccgaggacgtgagggattaccttctgtacctgcaagcgcgaggtttgtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgcctaggtctggcagtgaagaccatccagcaacaccttggacaactgaacatgcttcacaggcgctccggcctcccgcgccccagcgactcgaacgccgtgagcctcgtcatgcgccgcatcaggaaggaaaacgtcgatgccggcgaaagggcaaagcaggccctcgcgttcgagaggaccgatttcgaccaggtccgcagcctgatggagaacagcgacaggtgccaggacattaggaacctggcgttcctcggaattgcatacaacacgctcctcaggatcgcggaaattgcccgcattcgcgtgaaggacattagccgcaccgacggcggcaggatgcttatccacattggcaggaccaagacgctcgtttccaccgcaggcgtcgaaaaggccctcagcctcggagtgaccaagctcgtcgaacgctggatctccgtgtccggcgtcgcggacgacccaaacaactacctcttctgccgcgtccgcaagaacggggtggctgcccctagcgccaccagccaactcagcacgagggccttggaaggtattttcgaggccacccaccgcctgatctacggcgcgaaggatgacagcggtcaacgctacctcgcatggtccgggcactccgcccgcgttggagctgctagggacatggcccgcgccggtgtttccatccccgaaatcatgcaggcgggtggatggacgaacgtgaacattgtcatgaactacattcgcaaccttgacagcgagacgggcgcaatggttcgcctcctggaagatggtgactgagctagacccagctttcttgtacaaagtggccgttaacggatccagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaattgcggcaagcttgcggccgccccagcttggtcacccggtccgggcctagaaggccgatctcccgggcacccagctttcttgtacaaagtggccgttaacggatcggccagaatggcccggaccgggttaccgaattcgagctcggtaccctgggatcgaccgaagctgaccgaagcttgcggccgcacactgatagtttaaactgaaggcgggaaacgacaatctgatcatgagcggagaattaagggagtcacgttatgacccccgccgatgacgcgggacaagccgttttacgtttggaactgacagaaccgcaacgattgaaggagccactcagccgcgggtttctggagtttaatgagctaagcacatacgtcagaaaccattattgcgcgttcaaaagtcgcctaaggtcactatcagctagcaaatatttcttgtcaaaaatgctccactgacgttccataaattcccctcggtatccaattagagtctcatattcactctcccgggggatctcgactctagaggatcgctcaggaaggccgctgagatagaggcatggcggccaatgcgggcggcggtggagcgggaggaggcagcggcagcggcagcgtggctgcgccggcggtgtgccgccccagcggctcgcggtggacgccgacgccggagcagatcaggatgctgaaggagctctactacggctgcggcatccggtcgcccagctcggagcagatccagcgcatcaccgccatgctgcggcagcacggcaagatcgagggcaagaacgtcttctactggttccagaaccacaaggcccgcgagcgccagaagcgccgcctcaccagcctcgacgtcaacgtgcccgccgccggcgcggccgacgccaccaccagccaactcggcgtcctctcgctgtcgtcgccgccgccttcaggcgcggcgcctccctcgcccaccctcggcttctacgccgccggcaatggcggcggatcggctgtgctgctggacacgagttccgactggggcagcagcggcgctgccatggccaccgagacatgcttcctgcaggactacatgggcgtgacggacacgggcagctcgtcgcagtggccacgcttctcgtcgtcggacacgataatggcggcggccgcggcgcgggcggcgacgacgcgggcgcccgagacgctccctctcttcccgacctgcggcgacgacggcggcagcggtagcagcagctacttgccgttctggggtgccgcgtccacaactgccggcgccacttcttccgttgcgatccagcagcaacaccagctgcaggagcagtacagcttttacagcaacagcaacagcacccagctggccggcaccggcaaccaagacgtatcggcaacagcagcagcagccgccgccctggagctgagcctcagctcatggtgctccccttaccctgctgcagggagtatgtgagagcaacgcgagctgccactgctcttcactgatgtctctggaatggaaggaggaggaagtgagcatagcgttggtgcgttgctgtcaagggcgaattgtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgcgactctagatcataatcagccataccacattcgaatgtgagttgatccccggcggtgtcccccactgaagaaactatgtgctgtagtatagccgctggctagctagctagttgagtcatttagcggcgatgattgagtaataatgtgtcacgcatcaccatgcatgggtggcagtctcagtgtgagcaatgacctgaatgaacaattgaaatgaaaagaaaaaagtattgttccaaattaaacgttttaaccttttaataggtttatacaataattgatatatgttttctgtatatgtctaatttgttatcatccatttagatatagacgaaaaaaaatctaagaactaaaacaaatgctaatttgaaatgaagggagtatatattgggataatgtcgatgagatccctcgtaatatcaccgacatcacacgtgtccagttaatgtatcagtgatacgtgtattcacatttgttgcgcgtaggcgtacccaacaattttgatcgactatcagaaagtcaacggaagcgagtcgacctcgagggggggcccggtaccaagatatcaaccgcggaaagatctaagcatgcaagggcccaagtcgacctgcagaagcttcggtccgggcctagaaggccgatctcccgggcacccagctttcttgtacaaagtggccgttaacggatcggccagaatggcccggaccgggttaccgaattcgagctcggtaccctgggatcgaccgaagctgaccgaagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactctagaggatccatggccactgtgaacaactggctcgctttctccctctccccgcaggagctgccgccctcccagacgacggactccacactcatctcggccgccaccgccgaccatgtctccggcgatgtctgcttcaacatcccccaagattggagcatgaggggatcagagctttcggcgctcgtcgcggagccgaagctggaggacttcctcggcggcatctccttctccgagcagcatcacaaggccaactgcaacatgatacccagcactagcagcacagtttgctacgcgagctcaggtgctagcaccggctaccatcaccagctgtaccaccagcccaccagctcagcgctccacttcgcggactccgtaatggtggcctcctcggccggtgtccacgacggcggtgccatgctcagcgcggccgccgctaacggtgtcgctggcgctgccagtgccaacggcggcggcatcgggctgtccatgattaagaactggctgcggagccaaccggcgcccatgcagccgagggtggcggcggctgagggcgcgcaggggctctctttgtccatgaacatggcggggacgacccaaggcgctgctggcatgccacttctcgctggagagcgcgcacgggcgcccgagagtgtatcgacgtcagcacagggtggagccgtcgtcgtcacggcgccgaaggaggatagcggtggcagcggtgttgccggcgctctagtagccgtgagcacggacacgggtggcagcggcggcgcgtcggctgacaacacggcaaggaagacggtggacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggaaggatgtctgcatgggggactgtcgtgtctgcagccgcggcggcagcagcaagcagcaacgacaacatggccgccgacgtcggccatggcggcgcgcagctcttcagtgtctggaacgacacttaagcgtacgtgccggcctggctctccgaaagggcgaattccagcacactggcggccgttactagacccaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaattagcttggtcacccggtccgggcctagaaggccagcttcggccgccccgggcaactttattatacaaagttgatagatcgaataacttcgtatagcatacattatacgaagttatcctgagctgattccgatgacttcgtaggttcctagctcaagccgctcgtgtccaagcgtcacttacgattagctaatgattacggcatctaggaccgactagctaactaactagtacaaacgtgcaagcgctactagacaattcagtacattaaaaacgtccgcaatgtgttattaagttgtctaagcgtcaatttgtttacaccacaatatatcct

SEQ ID NO: 77 - DNA, 965 bp, Streptomyces spectabilis
atgcagaatcttcctgaaaagttcgatgaaacacgcctatgggaagctttgaggggatttggtgtgtccccgtcgcgtgtcacctacgcccccgtcggattcggggactaccactggacggtgaccgacgaggacggccggccgtggttcgccaccgtctccgacctggagcacaaggagcactgcgggcagggggcacaggccgcgctgaaggggctccgacaggccatggacacggcgctggccctgcgcgaccgtgacggactgcggttcgtcgtggcaccggtggccgccaccgacggcggcggtccagtactgcccctggacgcccggtacgcgctcacggtgttcccccatgtcccgggccgcacaggggagttcgggcagcgcctgacggaggccgagcgggaccggctgctcgccctgctcgcggagctgcacggccggacgcccccggagaccacaccgcccgccgacatggagcccccgggccttcccggcgtgcgcgcggccctggccgagtcggaagggccctggtcgggcggcccgttcgccgagcccgcgcggctgctgctgcgcgagcacgaggcgacgctccacgcgcgcctcgccgagttcgaggccctcgtcgcgcgcgtgaagggccggggcgcgccgctcgtcgtcacgcacggcgagccgcatccgggcaacctcatcctgggtgaggagggctatctcctggtggactgggacacggtgggcctcgccccggccgagcgcgacctctccctgatctcggacgacccggcggacctcgcccgctacgccgagctgaccggccgcaccccggacccggacgccctcgcgctctaccggtggagtggttccgcgccgagcaccagcgcacgcaggacaccgagtccgcgtggaagggcttcacggacacgctggggcaactggcggcgggcggatccgcagcctag

SEQ ID NO: 78 - DNA, 993 bp, Legionella pneumophila
atgctaaaacaaccaattcaagctcaacaacttatcgaacttttgaaagtgcattatggaattgatattcatacagcacaattcatccagggtggtgctgatacgaatgcatttgcatatcaagcagattcagaatccaagtcttatttcataaagctaaaatacggctatcatgatgaaattaatttatcgataatccgtcttttacatgattctggaataaaagaaattatttttcctatccatacacttgaagcaaaattattccagcaactaaagcattttaaaataattgcgtatccatttattcatgcgcccaatggtttcacccaaaatttaacaggaaaacagtggaaacagcttggaaaagtattaagacaaattcatgaaacatcagttcccatctcgattcaacaacaattaagaaaagaaatatactcccctaaatggcgtgaaatagtcagatccttttataatcaaattgaatttgataattcagatgataagctcacggctgcctttaaatctttttttaaccaaaatagtgctgcaattcatcgattagttgatacttcagaaaaactatctaaaaaaattcaacctgatttagataaatacgtactatgtcattctgatatacatgcgggcaatgtgttagtcggtaatgaagagtcgatttacattattgattgggatgagcctatgttagctccaaaagaacgtgatttgatgttcataggtggtggcgttggtaatgtatggaataaaccccatgaaatccaatatttttatgaaggttatggtgaaataaatgtcgataaaacaattttgtcttattacaggcatgaacgaattgtcgaagatatcgcagtatacgggcaagacttgctttcacgtaatcaaaacaatcagtccagacttgaaagttttaaatattttaaagaaatgtttgatccaaacaacgttgttgaaatagcttttgctacagagcag

SEQ ID NO: 79 - DNA, 2556 bp, Agrobacterium rhizogenes
atgatttgggatcatttatcaccttcccgaagggttctgcttgatatcaaatcgtggtctgtattggtactggtaattgcctcgatatcttttgcggttctggccataggatcttggcaagacaacgaaagcaacgaagcgatcctgacagagctgcaatcgatcgacgtggattgcgcgatgctgcagcggaatgtgttgcgtgctcacgccggccttcttcggaattaccatcctcttatcgtccctctggggcgactgcgcacgagcgtcgcagatttacagcagctttttaggcgggcgggcctcgacggggccggtgaattttctgaattgctggcgcgggtgaagagctcagtagatgcgaccgacgcagccgttgcagcgttcggtacgcaaaatgtaatgttccaggattcgttggcgacctttaaccagtcgatagcttcgcttccgaggtctttggatacgagggatttgaactcgctagaagtcgctgagttgggctatctgatgctccagttttcgtctcagccaaatttcgagtttgcacgggaaatcaaccaacgtctcgaccggcttcaggtttcggcgaacggggataaggcaggcgtcaaggagatcgttcgcagtgggaggattatcctgactctactgccgcgattgaaagacaccgttggagtgatccaaacttctgaaaccatcgacaacacgaagaagttgcagcgagcataccttgaagcttatagcttggccagcgcgggtgaacagcgggtacgggtcttcctcggcgcagtttcggttttcttttgcttttgcataatttccctagtccataggttacatctgcgaaccaaggtgttgacgagacgactggacttcgaagaagtgatcaaaaagattgggctttgcttcgaagatgcttcagaagcaaaaccgtcgttggaatcctcaacgaatgccgcgttgggaattatccaattattctttgaagctcatcaatgcgcgctgggactggtcaacatcaatgagaatgacgttggcgtcaccttttttggaagcactcctgcgccagagtggaacgaacaacgggtgcgcgaaattgtttccacggtaggggccgaggacggcgggcggattttccgagcctatcctcaacgaaaagcgagctgcttcggtgaggactctccatttctgtgggtgctgcttgcgttcaaggtatccgatcgaatagtcgctgtctttggcctgggatttgatcgagagcatctacagacgccgaccgcacgtgaaatgcagctgatggaactagcggctgcatgtgttagccactatgcggtcattcggcgcaagcagtcccagcgagatattctggaacgtcgtttgaaacatgcggaacggcttgaagcagttggtacgcttgccggcggcattgcgcatgaatttaacaacattttgggtgcagttctgggttacgcggaaatggcacacaacgttctgcgccgtcgtactcatgctcgagactacatcgatcacatcatttctgaaggcaatcgagcgcggttgattgtcaaccagatccttgcccttagtcgaaagcgggatcgaacaacaaaaccattcgatctttcggagttagtgaccgtgatcgcgccgtcgttacgtgttgcgttgcctccgggcgtcgagctcgatttcaaatatcagagcgctccaatggttatcgaaggaaactcacttgaggtcgagcaaatactgatgaatttgtgcaaaaactctgctgaagcatgccgagagttagggcgtgtggaggtcagcgttaggaggtctgtcgtacggaaacacaaggttcttacaaacggtactattcccaccggcgagtatatccttctttcagttgaggataacggcgcaggcataacagaggcggtattatcgcacattttcgagcctttttttactacccgcgcccgcagcggtggcacgggcctgggattatccacggttcacggtcacgttagcgcgatggctggttacatcgacgtggtatcaactgtcggcagaggtacgcgcttcgacgtctacttgccaccttcgtcgaagcagccggtaaattcagagagtttttttgaccctggaagaatcccgcttgggaacggcgagattgtcgcggtggtcgaacccgacttagccacgctggaaatgtacgaggaaaagatcgcggcgctgggctatgagccagtcggctttaacacgttggatggtttaatcgactgggtgttggaaggaaaagaacctgatcttgttctaattgatcaaccgtctttgctggatggagacggtgcagggtccttaatctcaaagctggcaaaagcgcccatcatcattattggcgaaaaccagaaaaatgttcccctttctgcggatcgcgagggatctgcccgttttttggaaaagccgatttcagcaaagactctcgcctatgtcgttcgtgcgaatatcagaactgaacgaatggtcggctcgaatagcagcggaatcgtgattgcgtcataa

SEQ ID NO: 80 - DNA, 720 bp, Agrobacterium rhizogenes
atgcggaagacggcaggatctttcgggatcatttttctgatggtccagccaagcaaagctgcgccgctctcgttcgctgaatttaaccaactcgctcgcgaatgcgcaccttcagtcgctccatcgacgcttggagcgattgcgaaggttgaaagtcagtttgatccgctcgtgctgcatgacaataccaccggcgaaactttacatggcaagaatccggcggatgctacgcaaagcgtaaacaatcgcgtcgcagcagggcattcagtcgatgtaggcctaatgcaagtgaactcgaaaaatttcgcgaacttgggcttgactgccggcaatgcaatcaacccttgcgtgtccctgtcggcggcggcggacctgctcgtacggcattatagtggcggcgacacggtagagtcagaacaacttgccatccggcgagcaatttcggcttacaataccggcaacccgacacgcggcttcgcgaacggctatgtgcggagggtcgaagtggcggctcagctactcgtccccccgctggctcagtcggggaaaaaaggcgaccgtgatgagcggagtccagaagaaccctggaacgtctggggttcatacgaccgctcccactcagcagtcggttcgtccgcgccgccagaggcgcagcagccgaatgagcgcaaatcccccgaacaagatcaagttttcgaaccgaatgatggagatgcacca

SEQ ID NO: 81 - DNA, 360 bp, Agrobacterium rhizogenes
atggcatggcttgaaggataccgcgcaccgtcgaaattccgtggcctctggcacagagctgtgcgcctgctggctccgcacgtgccgagcgtcaccggcgcgatcggctggagcttgtttttctgcgagccagctgccgcgcaggccgctgggggcactgaccccgccaccatggtcaacaatatctgcacgtttattctcggtccgtttggtcaatcgctcgccgttcttggtatcgtagccatcggggtatcgtggatgttcggccgagcttcccttggtctggtagcaggtgttgttggcgggatcgttatcatgtttggagccagctttctcggccaaacactgacagggggcggg

SEQ ID NO: 82 - DNA, 324 bp, Agrobacterium rhizogenes
atgaatgccgatcttgaagaagccacactctacttggcggcaacgagacctgcattgttctttggggtaccgctgacgcttgctggagttttcatgatgttggcggggtttctcatcgttgttgtgcagaaccccctctatgaaattgttctcttgccgctgtggcttggagcgcggctcatcgtagagcgggactataacgcggcaagcgtggtcttgctgtttctccagacggcagggagaagcgttgacggccatgcgtggggcggcgcgagcgtcagtcccaaccccatcagagtggcgtcgcgaggaagaggaatgacg

SEQ ID NO: 83 - DNA, 2370 bp, Agrobacterium rhizogenes
atgttcggagcaagcggacggaccgagagatctggggaaatctacctgccttacgtagggcacctcagcgaccatgtcgttcttctagaggacggttccatcttgaccatggcgcatatcagtggccttcccttcgaactggaggaagtagaggtccgaaatgcgcgctgccgtgcctttaacacgctctttcgcaatattgccgatgataacgtctcagtatatgcccatctcgtccgtcacaacgatgtgccagtaccgccggtacgccattttcgcagcaccttcgcgtcaagcctaagcgaaacgttcgagcggcgtgttctgtctggtaaactgtttcgaaacgaccacttcctcacgctcattgtctctcctcgcaccgctctcggtaaagtgggaagcagattcaccaggcgctatgggaagaacccaggcgatcttgcgcatcagatccgacatctggaggatctttggaacgttgtcgctggcgcgcttgatgggtatggacttcgtcgacttggcatccgagaaaaaaatcaggtgcttttcacggaaattggtgaagcccttcgcctgataatgacttgtcgttttttaccggtgccggtcgttagcggatccctcggcgcctcagtttataccgaccgggtcatctgcggcaagcgtgccctcgagattagagcgccgaaagatcgttacgttggatctatcttttcattccgcgagtacccggcaaagacgcggcccggaatgcttaacacactcctgtcatcaagttttccgctcgttttgagccagagtttctctttcctcacacgtgcacaggctcacgccaagctcagcctcaaatcgaaccagatgactagctccggtgacaaggcggtcacccagatcggtgaactcgcccaagcagaagattcattggccagtagcgaattcgtcatgggttcgcatcatctcagcctttgtgtctatggcgatgatctcgatacccttgccgactatggtgcgcgagcccgcacgagcttgtcggacgcgggcgcggttatcgtgcaggaaagcattggaatggaggctgcatactggtctcagcttccaggaaaccacagatggcgtacccgtcccggagcgatcacttcacgcaactttgccggcttggtttcattcgagaacttccctatcggaaggaagtcgggccattggggaggtgcggttgctcgtttccgtacaaacggcgggacgcccttcgattatattccgcacgaaaacgacgtgggcatgaccgcgatcttcgggccgattggcaggggaaaaacgacacttatgaccttcatcctggcgatgcttgagcagagcgtggttgaccgcagcgggacgatcgtttttttcgataaggatcgtggcggtgaactgcttgtgcgcgccaccgggggcacgtacctcacgttacgacgaggtgtcccaagcggccttgcacctttgcgcggcctagaggatacggcagcggcgcgggactttctccgcgagtggatcgtggcgctgattgaaagcgacggcagggggggaatttcgccggaggaaaatcgccgcttagagcgcggtatccaacggcaactttcgtttgagcctaacatgagatcccttgcgggcttaagggagttcttattgcacgggccctccgaaggtgcgggagctagattgcagcggtggtgccgaggcaacgctcttggctgggcgtttgacggcgaatcggacgaagtgaagttagatccttcgattacgggcttcgatatgacccatctcctcgaatatgaggaggtatgcgcgccggccgcagcataccttttgcatcgaataggagcgatggtagatggccgacgcttcgtcatgagctgcgatgagtttcgttcctacctgcttaatcagaaattcgcagcagtcgtcgacaagttcctgctgaccgtccggaagaacaacggaatgttagttcttgcgacgcagcaacccgagcacgtacttgattcaccattgggcgcaagcctcgtagcacaatgtatgaccaaaatcttctacccatcacccactgcagaccgctctgcttacatagacgggttgaagtgcaccgagcgagaatttcaggctattcgcgaggagatggcgattggcagccgcaaatttctgctgaagcgcgagagcggaagtgttgtgtgcgaattcgatctgcgcgacatgccggaatacgtcgccgtactatccgggcgtgccaatacggtgcgttttgcccagcagttgcgcgagacgcatggagaggaaccctctgcctggctggaaaaattcatgacgcgctaccatgaggcacaggattga

SEQ ID NO: 84 - DNA, 669 bp, Agrobacterium rhizogenes
atgaatattacgaagctcgtaataaacgcacttttcatatgccttgttctgtcggggactgccaaggcgcagtttgttgtcagcgaccctgcaacggaggccgaaacgctgacgacagcgatcaatactgcggcgaacctcgagcaattgatcacgatggtgacaatgttgacctcgccctttggcgtcaccggcatgttatcagcgatcgaccagaaaaaccaatatccctctgccggccaactcgacaaggaaatgttttcgccgcagatgcctgcttcgacaactgcgcgtgcaattaccttagatgccgatcgcgcagtcgtgggcgacgacgctgaaggaaatcttttgcgacagcagattgcaggcgccgcaaatgctgccggtgtcgcggctgacaatctggatgcaatggacaagcgccttgcggcaaattctgagacatcgggccagctctcccgctcacgcaatatcatgcaggccaccgtcaccaacggtttgcttctcaaacagatccatgacgcaattattcaaaacattcaggcgaccagcctgttgacgatgaccaccgcacaggcggggctgcacgaggcggaggaggcggcgacccaacgaaaggaacatcaggcaactgcgcttatatttggcgccgctcaactacactga

SEQ ID NO: 85 - DNA, 888 bp, Agrobacterium rhizogenes
atgaattttagcattcctgcgccttttacggcgatacatacgatattcgacctcgccttcaccgtcgggctggacacgttgcttggggacattcaacgggcagtcagcgctcctctcgtggcctgcgtgacgctatggatcattgtccagggcatcctcgtaatgcgtggggaaatggacgcacggggcggaatcacccgggtaatcatggtatcggtagttgttgctcttatcgttgagcaggcggaatatcatgattacgttgtctcggttttcgaggatacgattccgaatttcattcaacagttcggtatcagtgggcttcctttgcagacgattcctgctcagctcgacacgatgttttcactcacgcaagtagcctttcagaagattgcttctgaaattgggccgatgaacgatcaagacatcctcgcctttcaaggcgcacaatggattttctatggaacgctttggactgcgtttggaatctacgatgccgtcggaatcctcaccaaggtgctattggcgatcggtccattgatgctcgttggctatctcttcgatcgcactagagacatggccgcgaaatggatcggccagctcgtcacttatggcatacttctgcttcttctaaacatagtggcaactatcgtggttctgacggaagcgacggcactcgtgctaatgctcggggttatcacttctgctggcacaacggcggccaagataataggcctctatgaactcgacatgttctttctgaccggcgacgccttgatcgtcgctcttccggcaatcgccgggaatattggagggagctattggagcggtgcgacgcaaacggccggtagcttaaatcgccatttcgcccggacaatccgccgttag

SEQ ID NO: 86 - DNA, 153 bp, Agrobacterium rhizogenes
atgaagtactttctattgtttttgatcatcggcttggcgtcttgtcagacaagcgatcagttggcgacttgtaaggggcctatttttccgctgaacgtcgggcgatggcagcctgctcagtcggaccttcagcctaccaacgcaggagaggct

SEQ ID NO: 87 - DNA, 708 bp, Agrobacterium rhizogenes
atgaacggctctgaatacgcgctgttagtagagcgggaagcattggcggaccactataaggaagtagaagcatttcagtctgcacgtgctagatcagctcggcgaatctctagagccttggctgctttggctgtcattgcagtcgcaggaaacgtggcgcaggccttcgctatcgccgtcatgcttccgctgaacaaacttgttccagtatatctgtgggtgcgcccagacggtacagttgacagtgaggtatctatttcgcggttgccggcgacgcaggagcaagcggtcgtgaatgcgtctctatgggagtatgttcgtctgcgggagagctactcggcggatacagcccaatacgcctatgatctggtctcgagcttcagtgccccaacggtgcgtcaagattatcagcagttcttcaattaccccagtcctagctccccccaaaccatcattggtaagcgcggaaagctggaagccgagcacatcggctcaaacgaacttatgactggcgtccagcagatccgctacaaacgcactctcatcatggaagggcaagctccaatagtaaccacctggaccgcaacggtacattatgaaacggtaactaacttgcccggccgattgaggctgacaaatccaggcggcttaatcgttacctcctatcaaacttcggaagataccgtttcgaacacgacgcggagccag

SEQ ID NO: 88 - DNA, 876 bp, Agrobacterium rhizogenes
atgatcaagaatttgtttctgggcctggtttgtatcctctttgtaaccagcggcgcgaacgcggaagacacgccagcggcaggcaaactggatccacgtatgcgctatctcgcctacaatcccgatgaggttgtgcacctttcaaccgctgttggagccacattggtcgtaacatttgggtccaatgaagcggtgacagccgtcgccgtttccaacagcaaagatctcgctgcgctcccacgcggcaattatctgtttttcaaggccagcaaagtgctgcagccgcagcctgtgatcgtccttaccgcaagcgacgcaggaatgcggcgctatgttttcagcctcgcgaccagaacgatgtctcggctcgataaagagcagcctgacctctactacagcgtacagttcacttatcctgccgacgttgccgctgctcgccgaaaagaagcggagcagagagatcttgcggatcggatgcgggcgcaagcacaatatcagcgtcgagccgaggacttgctcgagcgtccgccagcaggtggcagcacagatgcgaaaaattggagctatgtcgcgcaaggagaccgctcgctattaccgctcgaggttttcgacaacgggtattccacgacatttcgctttcccggaaacgtgcgtgtaccttcaatctacgtgattaacccagatggcaaggaagccacggccaactattcagttaagggagattacgttgaagtagcatcagtttccagggaatggcgtctgcgggacggccatacagtactttgcatctggaataaggcatatgacgccgtcggacggaagccgggcactggcacagtcagacccgatgtagtgcgcgtgctgaaggagacgagg

SEQ ID NO: 89 - DNA, 1131 bp, Agrobacterium rhizogenes
atggaggacgtgaatgcccaatccagagaaggtatcgacgcgcccggatccctcgtcaccgatcctcatggccggcgcctctcggggtcgcaaaagctccttgttgcgggtttagtcctggtactgtcgttgagcctcatttggctcggggcgcgttcaaagaaaaggaccgagccgtctccaccaaacacaatgatcgatgccaacacgaagccctttcggccggccccgattgatattcccgccaaaccggcaatgacaccgccagctgcggaagcaacggttttgccgtcggatcaacatcagcgagaacacaacgaactgaggcccgaagaaacaccgatctttgcctacagcggaggtgatcagaatggtgtcaaatccgccccacacgctgatattcagaacggtggccaagacaatagaaacgccaactccctagccgcgtcggaggattctgctgagaacgatctctctgtgcgcttgaaaccgacagtgttgcagcctagcctcgctatacttttgccgcacccagatttcactgttacgcaaggaacgatcattccctgcatactgcaaaccgccattgatacaaatctggcagggtatgtgaaatgtgtacttcctcaagacatacgcggagcaaccggaaatgttgtgcttctggatcgcggaacgacagttgtcggcgaaatccagcgtggactgcagcagggagacgcccgcgttttcgttctctggaatcgcgcggagacgccctcacacgccgtcgtctctctttcctccccgggggccgacgaactcggccgttccggactgccgggtacggtcgacaatcatttctggaaacgctttagcggggccatgctcctgagtgtcgtccagggcgcagtccaggcggcaagtagctacgcagggaattcgaccggcgggaccagcttcaatagtttccaaaacaatggcgaacaagcggccgatacggccctaagggcggccataaacattcccccaaccttgaaaaaaaatcagggtgacacggtctcgatcttcgtcgcgcgggatttggatttctcaggaatctaccagcttcatatgactggtggatcggtgaaacgtcggcatctgcgctaa

SEQ ID NO: 90 - DNA, 1035 bp, Agrobacterium rhizogenes
atggaagtaaatccgcaattgcgcgcccttcttaacccagtcttgcaatggctcgatgacccgaggactgaagaagttgccataaacggaccgggagaagcctttgtacgccaaagtggcgtcttcacgaggttcgccgcaccgttctcttatgatgatctcgaagacatcgccattctagcaggggcattgcgaaaacaagatgtcggcccccgcaaccctctttgcgctaccgagctcccaggtggcgagcggatgcaaatctgcttgccgccaacggtaccctctggcaccgtgagcttgacaattcgacgaccgagcaatcgtgtctctgaattgggggaagtctcggctcgctacgatgttcgtcgatggaatcagtggcaaatccggacgcagcgacgagatcaactagacgaagcgattctgcgcgactacgacaatggcgatctggaatcatttttacgtgcatgtgttatcggtaagcggacgatgttgctttgtgggccgaccggaagcggcaagaccacgatgagcaagaccttgatcagtgctattccgcgggaagaaaggctgataaccattgaagatacgctcgaactcgtcattccacatgagaaccacgtcagactgctctactccaagagtggggcagggctaggtgcagtgactgcggaacagctgctccaggcaagccttcggatgcggcctgaccgaatattgctcggtgagatgcgcgacgacgcggcgtgggcgtacctgagtgaggtggtctcaggccaccccggatcgatttcaaccatacatggggcgaatcccgtccaaggcttcaaaaagctgttctcacttgtgaagagcagtgtgcagggggcatgcttggaagatcgcacactgattgacatgttggcaacggcaatcgatgtcattgttcccttccgtgcttacggcgatgtttacgaagtgggcgaagtatggctcgccgccgatgcccgccgacgcggtgagacgataggggatcttctaaaccagcaatag

SEQ ID NO: 91 - DNA, 690 bp, Agrobacterium rhizogenes
atgcgccatcttattaccgagtatttaacgattcatgccttaagggtcaccgcggtatcagatagccagcaattcaaccgggtacttgcatcagagacggtcgatgtcgtcgtcgtggatctcaatttagggcgtgaagacggacttgagatcgttcgcagtctcgccacaaaatccgatgttccaattataatcatcagcggtgatcgccttgaggaggcggataaagtggtggcgctcgagctgggagcaacggattttatcgcgaaacctttcggaacgcgcgagttcctagcacgcatccgtgtcgcattacgcgtgcgaccgaatgtcatgcgaaccaaagaccggcgttcattttgtttcgccggctggacacttagtctcagacagcggcgattggtatccgcacaaaatggcgaggtgaagcttacggcaggggaattcaatctgctcgtcgctttcctggaaaagccacgcgacgtgctttcccgagaacagctcctcatcgcgagccgagtgcgtgaggaggaagtatatgacagaagcattgatgttctcattttgaggctccgccgaaagcttgagcaggatgcagcgagcccaaacttgatcaaaactgccaggggtgccggctatttcttcgacgctgatgtggatgtttcctatggaggtctgatggcggcctga

SEQ ID NO: 92 - DNA, 696 bp, Agrobacterium rhizogenes
atgaaacttctgacattttgctcatttaaaggaggcgccggcaaaaccacggcgctcatgggcctttgcgctgcgtttgcaagagacggcaaaagagtggctctcttcgatgcggacgagaaccggccgttaacgcgatggaaagaaaacgcgatgcgtagcaacacctgggatacatcctgcgaggtgtacgctgcagaagaaatgtcgcttcttgaagcggcttatgaggacgccgagcttcaggaatttgattatgcgctggccgatacgcatggtggttcgagcgagctcaataacacaatcatcgctagctcaaacctgcttctgatcccgacaatgttaacgccgctggatatcgatgaggcactttcgacatatcgttatgttgtcgagctgctgctgagcgagaacttagtgattccgaccgccgtgttacgccagcgagtcccggttggccgattaaccacgtcacaacgcgcgatgtcagacatgctggtgaatctgcctgtcgtacaatctccaatgcatgaacgagacgcgttcgctgcaatgaaagagcgtggcatgttgcatctcacattgctgaacacgacaaatgatccgacgatgcgcctccttgagcggaacctcagaattgcgatggaggaactcgtaacaatttcagaattgattggcgataccttggggaattga

SEQ ID NO: 93 - DNA, 606 bp, Agrobacterium rhizogenes
atggggatccgcaaacctgctttgtctgtcggtgaagcaagacggcttgctgccgcgcgaccgatcgttcacccaatcccagctctttcctcgcaaaacttggcgccttcgcaattacctgaaagagccggaaaggaaaaacgaccagcgcctcctatcgccgccaaacgtcgtgacaacttcgatcggcaatcaatgctaacggcggacgccttgagttcgactgcgccgccggaaaaagtccaggtctttctttcggcacgcccccccgctcctgaggtatcgaagatatatgacaacttgattctgcagtacagcgctaccaaggcgctgcagatgatcttgcgccgtgcgctcgccgattttgagaacatgttggcggacggatcatttagcacggggcctcaaagctacccgatctcaaaagtagtcgaaaaacctatcgttgtcctgacttctcgcatgttcccggtatcgctgttagaagtcgcacgcaatcactttgatccattgagattggagaccgccagggcttttggccacaaactggctacggccgcacttgcatctttctttgccgaagagaagataagaaaagaacgctaa

SEQ ID NO: 94 - DNA, 447 bp, Agrobacterium rhizogenes
atgtcgcaaagcgaaaaatccacttcaagtgacattgtcgaccggcgtgaaggcccgaagattgaaggtttcaaggtcgttagcactcgtttgcgatcgtcggaatatgagagcttctctcgccaagcccgtctgctggggctctccgacagcatggccataagagttgcggttcgccgcattgccggctttctcgaaatcgatgcagagactcgtcagatgatggaagccattcttcattcaataggagcactctcaaacaacattgccgcgctgctgtgtgcctatgctgaaaatccgacaacggatttgggcgctctgcaagctgaacgaaacgctttcggtaaatcgttcgctgatctcgacggtttgctccgttccattttgtccgtatcacggcgacggatcgacggttgctccatgctggcggacgccttgcagcattaa

SEQ ID NO: 95 - DNA, 1176 bp, Agrobacterium rhizogenes
atgcccgatcggtctcaagtcatcatccgcattgtgccgggaggtgggacgaagaccctccaacagattatcaaccagttggagtatctatctcggaagggcaagttggagctgcagcgttcggcccgacatctcgatactttcgtaccaccggatgaaatccgcgaactcgccctaagctgggttcaagaaaccgggacttatcacgaaagtcggccagacgaggaaaggcaacaggagttgacgacccacattattgtaagcttccctgccggtacaagtcaggtagcagcttatgcagcgagccgggagtgggcagccgagatgtttgggtcaggcgcagggggaggccgatacaactatcttacagcctttcacatcgatcgcgatcacccacatctgcatgtggtcgttaatcgtcgcgaacttttggggcacggctggctgaaaatatcccggcgccacccccaactgaattatgacgccttgcgcattacaatggccgagatttcacttcgtcatggcgtcgtcctcgaggcgacgagccgagctgagcgcggcatctcggagcggccgatgacttttgcccagtatcgacgcctggagcggcagcaggccaatcaaattcgtttcgaggatattgatttcgaagaattctcgcctgggggaaacgacggagaaccggatcaatcttttaattcttcgtacggttcgctgcctcaaaacgtgtcagaaaacttgcgacgaaacggcggtctgcaatcggtgtctgaagtacgttcccgggcactgatcggatcgaacggcaacggtgtcacgcccgatcgtgtatcatctggaaacgattcccgttctcaatccggcagcgataaagcctttgtggacgatggcaacttgaggaacggccctctcaccatcgccggagacggccaggatcttgaaggccgttctggcatgcatcgtttggcaaccgaacccgtcacgcacacaacaagcgaagatgatgttcggcaacggcctcatcgaaaacggcctcgcggtgatgaggaagagcagagcggcgcaaaactgaccagggtagacggaattcggacgggagtgacaatcagcgccgtaccggttgcccaggacgatccgattacatcgccgatccagccccctggatcaaatccgttg

SEQ ID NO: 96 - DNA, 3024 bp, Agrobacterium rhizogenes
atgacccggggcagaccaacatcgctacggacgcattgcctccgacagccgatcgccggcagcagggagagccaaattctaagcgtcctcgtgatgatgacgccgagccgagcattcgtaagcggtcaagggacgggcgcagccaaggggatgagggaaacagaaggtagaaaaggatcgatcatggcagatgaagaatttcgtcgagacttcagccgctccgctacgttgaactcgaataacgaaggcgctacaggcgcaccaatcccggatacatcggtgtcgactgccttccgacaaaaccgcagagaacacttaacgaccagttccttacggccattaattactggtggggccggcgaccttccaggcacttcccccgaaaatcaacggccgacaacccatgccccgaatacagcagaaatactcccggtgagatcagccgaagctccggctggccaatcagcggtctttccgaggagcaaggggtattttcgtacggccatgcaatacctgcgggagattgaaatgcagtccactgccagggcggaccacgaggcgacgtcgtcgtcacgttttggcaagggggaaagaaagcagctgcgcgaacacgagcaaaccggtgatcaaagtgaatcaatggcgaagcggagtaccagctcgggaatgcaggtgggaactattgccgcgtctttggctatgaaagatagctcgaccgcgacgccggcttcgcaagggccgcaccggtctgggatggagctggataatatcgaagggactggagagagccgtacgcaatctcagcacgaaattgcgacacaacctattgccacaagcgcttttggttcaggtcatgatgtgatcattcctggagagggccagcctgaagaaacattcgacggcgcaccatattggatggtagaaagcggggatagcgagaccaatagccttccgtcgatccaacaaggcttatcttggccagggttagatgaccttgatttgctcgccgacagcagttcaccgctcagtactcaggttgttcctcctgacgtagccgctacgaatttaagcactgaggcagggtccgccagcgtcgaaagcacccaaatcctcgccgacagtgcctattccgacgacgcgaccgaaaccggtggccaaacagcttcaggatcgatccatgaaggttcagttcgttcgcttggctcaccggaggaacgcttcgacgcctttcccgagttgaccgacgaggacttggcgcagattgacgcattctcgcgagcccgctctccttcgaggcgagatgctgcgcacgctattcatgcggtcagcttggatgatgccttctcacgcaaggatcttgccgcgggccacgacggccggcttacgaatcctgcgttccgtcaggaggcttctctgcaggaatcgagcccatcagaaacgaagtccgacgacttcccggaattaaccgacgaggacctggcacggatcgacgcactctccgaagcccgctcaacttcgaggctggatgttgcacgcactattcatgcggtcaggttggaggcctctcggcaggacccgagcccatcagaaatgaagtccgacgacttccccgaattgaccaaagaggacttagcccggatcgacgcactctctggaccccgcccgactacggggcgggaaggtgcgaacactattcagccagtcaggttggacgatgctttctcagccgaagattataccgtgggccgcggcggccggcatacgaatcctgcgttccatgaggaagcttctcggcaggacccgagcccatcagagatgaagttcgatggcttgccggagttgaccgacgaggatctggtaaggattgacgcaatctctgaaccgcgctcgaagagatctcgctccgagcaggttgtcgggggaaaatctcataggctcaaactgaacgaggctatcgaggaggcgggctcgcccactaccgtttcgggaacaagcgccgccagggcggcacctatcacgctcgaaagcggagtacctaggttgccgcaggctacccatacggaacttcctggctcggacgttgcgggtccactgcggatcgggaaggcgtcgtgtgccgatatacggcgagatgtttcggataaagggaaacgaaaagtctcgtcagattatcagattcagcaaggtcctggcgcgtcctatgcttaccagccgcgacgcatgccgacggaagcgattttcgatgctgaacggcttggtgacgaagtgctcatcgggaatgagccagttccgcggtggccttacccctgggagcacgttgttcgttttgaaacaggcaagcagctcttcgaaagattgcagaagtggccgactgcggaggagttggaaaacagtgtgatcctcgtcaaagcggatagcgcgcaacgatcctatatgccccgaaatcagctgctcttgcatctcggatccgaaaagtattacgaacgaatgaaagcgctcggtctatccgataataccttcagcggattgaagtccgatagcaaatatttttatgatacacctgctggaccacgggtaagtgaacatgattatgagttcccgcggcaggcaggcgtgcataatccagaggtgatggttcagcatcatagcggaaccttcttcgcgttttggccaaaacttctcaggctggaaaagcttgcgacagtaacgaatacgtatggcgcggaaaatgtttggctcaaatcgccagccaatgcttacatgacgccggaaacctataattccaaggttgcgaacggcgccgaaaaccttttcatcgagttcctacgtcccgctcctgtccacgaccacctgcgggaacctggaacttcaaacgcaaaaactgttgacggacgaaacgaagatcgcgcgcaacaggccgaccggttagcagatcagtcgatgggccggaacggggacggccgtgacgcgcagggtggtaagagaaccttggaaccgcgcgtgcgcgaaaggtatgggctgtag

SEQ ID NO: 97 - DNA, 1983 bp, Agrobacterium rhizogenes
atgaattcaggcaagtacacgccaataggcctggctgcgagcatagcatgttcattggccgtggggttttgtgcggccagtctctatgtcacatttcgccatggctttacgggcgaaacgatgatgactttcaacgtttttgcgttcctgtacgagacaccgccttatttgggatacgcaagtcctacgttctatcgcggactagccatcatcgttgcgacgtcaacgctcgtgttgctatgccaactactgttatcgatgcgcgagcgcgaacatcacggcactgctcgctgggccggctccggcgagatgcggcacgccaggtacctccggcgctacagtcacgtcacgggtcccatcttcggcaagacatgtggaccacgttggtttggcagctacctaagtaacggagaacaacctcacagccttgttgtcgcgccaactcgcgctggtaagggtgtcggcgtcgttatcccgacgttgctaaccttcaagggctcagtaattgccttggatgtgaaaggcgagctatttgaactcacatcgagggcgcgtaaatcaagtggcgacgcggttttcaagttctcgcccttagatccagagcggcgaacgcattgttacaatcccgtgctggatattgccgcgttgccgcccgaacggcgctttacagaaacgcgccgcctcgctgcgaatctcatcacagccaaaggcaagggagccgaaggtttcatcgacggggcacgggatcttttcgtagcaggcatattgagttgcattgagcgcggcacaccaacgatcggtgccgtttacgatctgtttgctcagccgggtgaaaagtacaaactatttgcgcaactcgcggaggaaacacaaaacaaagaggctcagcgtatcttcgacaatatggcggggaatgacaccaaaatcctgacatcctacacatcggtgctcggcgacggcggactcaatctttgggccgatccactcgttaaagcggctacaagcacctcggatttttccgtctacgatctgcggcggaagaggacttgtatttatctttgtgtcagcccgaacgatctcgaagtcatagcgcccttgatgcgtcttctcttccagcaggttgtatcaatcctgcagcgatcgctgccacttggagatgaacggcacgaagttctgtttctcctcgatgagttcaagcacttgggcaagctggaagctgtggagacggcaattacgacgatcgccggctacaagggccgcttcatgtttattattcagagtctttcggctttgacaggaacttatgatgaagctggtaagcaaaattttctcagcaatacgggtgtgcaggtattcatggcgactgctgatgacgagacgcccaactacatttccaaagctatcggcgactacacattccaggctcgctcaacgtcgtacagccaagcgcgcatgtttgatcataacatccaaatctccgaccaaggagcaccgcttttgcgcgccgaacaagtccgcctactcgacgacgattatgaaatagtccttatcaaaggccaacctcccctcaaactgagaaaagtgcgatattattcggatttcatattgaagcgaattttcgaaagccaacacggttcccttcccgagcccgcatctttgatgttgccgggagacacaaacctcgttgaaggcaagctcgaccagggaacagccgatacaacttcgcaaaaaccggtgcagattgaagagaacgaccatggggaagtcgtttccccccaaaacagaactgtggctgatggagtaatgccaatagaagttcgcccccgttcaaacgaagttgatgacgagcgggaataccaaggcgcggacgccgcaacctctgagaagcttccggaaattgctccggctcttttggcgcagcgcgaactcctcgaccagatcatttcgctccagctacgaggtagaacagcctccggcacttga

SEQ ID NO: 98 - DNA, 2508 bp, Agrobacterium rhizogenes
atgaaaccgtcgggaagctcaaaaactggatacgccgggtcggctagatcctcgccccaggttcgcgcaggggttacgcctgtccttcatcccaaagagccttggaaccgttttgcttgctccccatctgacggccaaatggatcaccgggaaaatttatctgcgcaattcgcttacgatggaatgagactgggcgcagccgagcggtccgcgtacgagacatgggatagagcggaccggccgagttggaaagacctgatactgagcgctcgcctgaacgcgattgacagtttcgcttggaatgtcgatgtcggagaaagtacctcttcaacttttgtttatgatggtgttcctctggcggaaggggaacggcatgcctacgaggaatgggtggagccgggacagcccagttggcaacaactcgttgtgaacgcgcgtattgaagagctaaacacctctgctgcaattccgaatgagtgtagtccccttcaagaggaattccgatcggaggcgcctaagcgtaagcggacaagctccattggtcaaaagaacggtttccctgaaccattcgaatttgatgggatgagactcggctcgcctgagcgcgaagcatatgagaattggagtaaaccgcaaccgccatcctggaaagacctgatagttgacgcccgtcttgacgcaatcgacacctccacctggctcaacgaatcaaatgacacctcggtcttcgagtacgaaggcgtcccgcttggggagggggaacgcctagcatatgaaaaatggctcgagcccgcgcaaccaggatgggaagacctggttgtggacgcacgcgttgcggaattgcaccagtctgctccgacgtggtgcgaacaccaaccaggcaacgacgtttcttccaacgagtccgggcgcatctcgggcgtcccaattaacgccgagcaggtgtcgcgtgcgttcttcgtgtacgatggagtggcgctcggagcagccgagcgcgctgcgcatgatcgttggagcaggccggaccggcccacctgggaagatcttatcatagtcgcgcgccaagctgctatcgaaggcggtgccgtttcgaatgggatgatcgggaagacatcttcctcagtctttttatacgagggaatgttgcttggggatgcggagcgtcaggcgtacggacggtggaggcagctagcccagccgcggtggcaaaatctggtggtgaacgcgcgcctggcagagctcgacccggcggcctggattcccgatgaacatgatccgtctgaggatggcggggcgactggtcttctgtcgcaagcaagcacgaccaataagtcccgcctcagtttaggtgatcaaccggaagcgcgctcgcctagtctcgcacgtgagccagcacaacagccgactcacgtgcaaaacctgacgtgcgcacaattggaagcaagacgtgctctatatttcgggccctctgggagggatgcagaccaaaccgccagcatcgccgacagtaatcgcctcgacgaggtaagcaaagttaaacggctgggtgccaagagccgtcgaggcgctaaagcaacggcctatgacgtaatttcaagtgcggaaagactgtcgtctcacgagggttgtttgacggttcagtccactcagccagaaaaagccgcttgctcgagaagcgacaatatcggcacttatggaagtcgaaaaaacgaacgagctcggcttgcgaccgagaccgggaaatacgagtcggagcatattttcgggttcaaggttgtccacgataccctgcgctcgaccaaagagggccggcggctggaaaggcctatgcccgcctatctcgaatgcaaggaacttcatcgacaacatgttggtacgggaagggggcggacccgactggtggggcgcggctggccagatgacgcaagttaccgctcggatcaaagggcaactctatcggaccctgttgcgtccacggaaggtgcaacggcgtcaaacgggtatcaattaaaccagctaggctacgcacaccagctcgctaacgacgggctgcagagcgaaacgccagatggggttatcatgccgcttcaggtcgcgactactagctacaactatacggtaagccgcgatccggtactttctccgcccagtaaagagcaagctccggaattgttgcaccttgggccacgtggccagacagaagctgtactcgctcgcgaaacagcattgacaggaagatggccaacacgcgagcgtgagcagcaagtctatcgagagtttttagccctttatgacgtcaagaaggacctggaggccaagacacttgggttgcggaagaaaaaagctgcgcttgtttccgcgttgaaccggactgccgcctcaataggcacttcacccttgaaagcccaatcgtcgagcgcagaagttgaaaaagcaactcacgagtttgatgaacgacgggtttatgatccgcgcgatcgcggtcgggacaaagcattacaacggtga

SEQ ID NO: 99 - DNA, 930 bp, Agrobacterium rhizogenes
atgcaggaacgcgagctttcggtcctcggtggtgataagaccgaaagtgcagccaccttaccgaatgacattttggtggaagttgccaaacatctgccgaccgacgatccagtcgaaacggcagccaacctcacaagctttaaacttgcgagcccgtcggttcgggcatcggtcgatcagagcgatgtcggaacgttccaccgaagcgtaaatcgactgggtgcctcaagcaaggcattgtatgacctggctgtaccccggaacggctttgccgagtatccgaactatccggaaccggaccctgctggcgagtttgcgctggcgagccagcgcatcaggacaattggtccaactttgaagttccaatcgcccgccaggaaaacagcgatcgtcaatcacattctcaatatgtcggaaggcggtgagcaggcggaggcgattatgtcgatgacgtcccatttgagtgacctcgagagggccgacaagagacgccttatcgacagagcaattgaatacttcaaggtagacgggcctatcaactacgacagtcgccattatgcagcctacgcgattgcagcggcgcacaaccagttggaactcgaacacaagtcacaaatcttcgatgcaatggcgaagagaccccagcttgcgagactctacgccgacgaacgcatccatgcgcaggagcatttggggcttgcgtcgacatccgaaggtccgcacgagcggagcaataaacaactggccacggacattcttcagatcgaacaaaaaatccgcactgagctccttcccgaaactctcagtgctcacgaccagatggtaaaagcggaaggaatcgctggatcgattgagaaggcttaccgcgatgctcgcgcgaacttaacccgggcaccgcgagggaggtcaaattctgatctcagccggtag

SEQ ID NO: 100 - DNA, 1356 bp, Agrobacterium rhizogenes
atggtcagtataaataaaaaagccccgcagaaatcttctacagcgaccacgcgcaattctgatgaacgcctggttgatcagttagggcaggcgtaccttgtggaacgcgaggcgcaggaaaggcgcgcgcgacttgaagcgccgccggcgttgaaaaaatatgcctcgaaactgcaactcctcaataagctcgatgcagatttccgtggtgtgatcgcccacaagccgtttcgcagcgagcaactgcgggtcgatagcaatggagaattgacccatagtcggggtctcataaaaaagaagaagaaggttttcattcgagatcaaacaactggctcccttcggcttattcactacgagaggtctgactggaatagtgtccgtcgctatgactacgaccagaacggcgtgttgagcgagaaacatatcaaaagcaaagccggtgccttcgaagaaaaatgggagcgggacgaaaacggtgaactgatgcgcacccgatacatcgatcggcgcagacttactggacgggcgttgcatcccatttccgaggaaatcggacgtccttatgagagtggcctggagaagaggctttatcgcgttttaacgcgtcgggagggctcccaacaaaagactttcgaacgcgatgacaagggtaatctggagctcattgcaagcaaacggatgggctattcgatgtcttcacaaaaggcaccggatcgacaaacatctagaacaagtatccgcaagcttggcggagctttcagtgaatcatatagatcccggctggataaggacggccacgagttaggtcgggatgtctccgcacatcgaagcctcctcaacaagcgttcagccgtctacgatgacgctacaggggagctaaagagcagcaagcacacgtttgggaagatatacaaagcggaagcgacatacctgaacgccgaaatcaaagaggtctccaaaaaaatcctcggagttacggtcggtaaagaattgaagacattaagtggacgcgaactcgaggctcaagtattacgtgccgcggaacgtgccctccataaacaggcctggcagcacccttcagctaacccctcgcggtcgcagcgggaaaataccaacagtcatcttggaaacgaacttgatgggccgctcgaatcggatatgaccgtcgtccatcaagccggatccgggttcgtcggcgacgatcgccacgttcatgatggcggtggatccaggttgaatgaattgcacgaatcgcgatcgtcgaatgatagggaaaagcttagttcgccgagagccgaaatttgcgaccgctcgatgaatcgggatcgcaccggctcaggtactttgtcgcgatga

SEQ ID NO: 101 - DNA, 5310 bp, Agrobacterium rhizogenes
atgccaaccgacgacattgtaatgtccgatcccggaatggctgctgttgacacgtctgtccctacgcgcttccagacagatcttcgccagttcagtaacctgctggacgagagcaatattgtggaatgggtcgtaaaccacgccgcaaatcgcaatgcgtgcttcggacaagaccaacttaagatttcggcggctcgggcactcacgcactacaaacggccggtacaagaaatcgacctgctattccaacaggtcgtcgcaagcgacaaactgacccggcttgattctccagatggccaacctctctacacctctacagagctgagagctgcggaacagaatactgtacgtcatgtcaccaatctttccgcagaagaaagcttcggcgttccgggaaccattgttgatatggtcgccgatagaggcattttcacaccggagctcagaggagcattacattatctgtctaggcgaaatcgagcttccactatggtgggcgtagcgggttccgcaaaaacaagtgtacttggagccctgaacgaagcggtggacaggttcaacgaggaagcgctcccgaccgagaaaataaagttgattgccttcgtacccaccaaccgggcggcccaggagcttcgtgagaaaggtcttcgcgacgtcgcgacgactttcaaggcgaaagaccgcaccatcggaaaaaataccatcgtcgtgatcgacgaaatgtcgatggccaagacgcaggagatcgcgcaactaatcgagacagttgcaaatgccacttcctatcacccaaccgaaaggccgaaactgatatgtgtgggagacgatcggcaactgccccctgttggacctggtgatctgcttccgattattatggagcaagccggctgctatgaactcgtccagccgcttcgacagctcgacgcgcggtcgcgaatagaaacagaaaagctcggacgtgacatacgacgcgatgccaagagcgccgtcgggcactatctcacagcgctcgaacaaatgggcctcgtccatttcgtatatgctcctcctagcggctcaaacgtcagggcgtcagaccagatcactgaccgcatgctggaggagatgaatagagtttgcgaccgatatccggtgtatgatcgtcttgtgatggcacactccaacaggagcgttaatcgcgccaatatcgctcttcatcagaggtttgttgacaaatccggattgcaagaccagcaaatgagtgtgtggtcaagcgtaatagatagtggaagttcggaatctggaatagatgagggttcgtcgagacgcgttcagcaaaggattaatctcgtcttgggagacaggattatattcagcgaaaaccgtctgcaagcggacatccgcaatggtacttttgcaactgtagtcggacttaatagcacagaagcttcccgagctgagaatggcacatctgctggggttcgcattactgcaaggttagacggatctggacgaaccgtcacttggaccgatagcgagtttaagggttttacctacggctatgctgctacaatttataagagtcagggggccacagttgatcacgccattctcctctgtgatggtgctctttcagataagctgacctatgtcggcctgacgaggcatcgcagtcgtctcgacgtcattgcttctcccctcgtggcaaacaatgttgaggctctcagtgcaaagctcactcagcaaagcgcgccaaataattccattcaattcccagcgctcgaacctgctgccttccaagagcgctcgtcggtttcgaacgcgcacttgctaaggccgctcgaccagatggaaatctctccaacgacgccgctttccttccaaggcagacaagaaagctccttcggggagaaccagctgcacgaaccatccacatcggatgtggaaatgccggaaagcgcggacctttacccgagcgccattgacttcgaagttttccagtcttctgtcatcacgactgaagagcaaatgcaaccggaattctgcgggtcggaatcgacggctaacacctcagcccacgaaagccaccaagtcacgatcgcaacggtaacaaacctggggatagcgatcgagaaacggaaacgagcggcggcaaaggaagaaatcgattctcgcaaaaaaatggcccgtcactcagttagttctgccgaggaagttgaagatatcacttccctgttcgaacgattgaaactggcaacctcggtcaccaacacagttcaaccgacgtatgcggacgtcgatcatatcatcggtactgatggccgagtgggtccaataccgcaccgggaagatgatccgggatcaaattgggaattgtcgtcaacgaacgccccctcaaacgtctcagagaaacgatcgaccaaagactcaggagaaaaaaatatggcttcgaatgaccagaaaatgcaaggcgctgactctgcaggcagcgagcgtcatttttcgcagacttccattgtggaagccctgcaggctggcgatcacaagaagctcgtggaaacgctcgccgcaaccggctcccttgtcgagaaggcggacgccgggtcggcgctgaaagcaatggcggatgcttacgaaagggatatcaaggcagatcccgaaaaggtccgcatgctctatgccaatcggcgcgttgatgtagatgcgctggccaaggagatcgaaaaacagggccttgcatccggtcgcctgagtggcgaccctgtcagcttcaaggcgttcaacaacaaggatatccgtttcagggtcggcgacaggctcagcgtcaccagcagctacaggaatctcattgccggtgaagccggccggatcgaaaagatcgaaggcaaatccgttaccttcaaacccgatggcagcagtcagagcaagaccttcgaggccagcaccggcgagccgggtgacaggggcgtcaagggctacaaaatcgaaggcccgatgacggtcatcggctccgcctatgaacttacgcgacatgatgacggcaaacgtgttgaccaaatctatctcttgaacgacgctgcccatggcatcaacgccaatagcgctttgctgagcaaggccgacgagcggacgcagcttttcacttcgctcaaggacaccgccgacagggacatcttggccaggcaactgggaaagccgggcagcgagctctaccaggacaaattcccagccttgccggactacacagccgccatcgatcggattgcaaaacgccaggaagttgtcgcggcacgtggcgaggagaaaacttccgccccgatagacctggcgccccaaacgccgcccgacgctgccgatgcggcagtcaataaccagaaaagaatcgtcgaggccttgcaggcaggcgaccacaagaagcttgtggaaacgctagccgcaaccggctcccttgttgagaacacaaatctcgtatcaacgttgaaagcgatagcgcagacttatgaaagagacattagtgcggaccccgagaaagtccgcgctctctacgccaacaaacgtgatcatgtagatttgcttgccgaagagatcgaaaagcagggccttgcatccggtcgcctgagtggcgaccctgtcagcttcaaggcgtttaacaacaaggatatccgtttcagggtcggtgacaggctcagcgtcactagcagctataggaatctcattgccggtgaagccggccggatcgaaaagatcgaaggcaaatccgttaccttcaaacccgatggcagcagtcagagcaagaccttcgaggccagcaccggcgagccgggtgacaggggtgtcaagggctataagattgaggggcccacgacaatcatcggctccgcctacgaaatcagaaatcacgacgatggcaggcgcgtcgatcaggtttatgtcttgcacagtgccattttcggctcaaatgccgcgagcgccctgttgagcaaggccgacgaacgaacccaggttttcaccgtgcaaagcgacacggctgacagacacatcttggccagccaactcagcaagcctggcagcgagctctatcaggacaaattcccagtctcgccggactacgcagccgcgatcgaccggatcgcgaaacgcgaggaacttagggccggacgtggcgaggaaagtcctactgttcaaatggagccggtgaaccaaacgccctacgaggcgggacattggacgcctgacagtcaaaaatctgtggtggaagccctgcaggctggcgatcacaagaagctcgtggaaacgctcgccgcaaccggctcccttgtcgagaaagcggacgccgggtcggcgctgaaagcaatggcggatgcttacgaaagggatatcaaggcagatcccgaaaaggtccgcatgctctatgccaatcggcgcgttgatgtagatgcgctggccaaggagatcgaaaaacagggccttgcatccggtcgcctgagtggcgaccctgtcagcttcaaggcgttcaacaacaaggatatccgtttcagggtcggcgacaggctcagcgtcaccagcagctacaggaatctcattgccggtgaagccggccggatcgaaaagatcgaaggcaaatccgttaccttcaaacccgatggcagcagtcagagcaagaccttcgaggccagcaccggcgagccgggtgacaggggcgtcaagggctacaaaatcgaaggcccgatgacggtcatcggctccgcctatgaacttacgcgacatgatgacggcaaacgtgttgaccaaatctatctcttgaacgacgctgcccatggcatcaacgccaatagcgctttgctgagcaaggccgacgagcggacgcagcttttcacttcgctcaaggacaccgccgacagggacatcttggccaggcaactgggaaagccgggcagcgagctctaccaggacaaattcccagccttgccggactacacagccgccatcgatcggattgcaaaacgccaggaagttgtcgcggcacgtggcgaggtcaagccgattgagcgcaccgaagcgcccgaaataccccaggttcaagctactatcgttggcgagacctcgatcattcggttgcccgatcggataaaaaccaatcgcgagaagccccaagaacttgatgtagtctcgaaagaagggcacgaaactacaggtagtctgaggcagagtgtccaagagagtaatgcagcaccaaaacagacttcgccgaaggcggcaaatgacgtggatcggctgacacgggattttgacgagcgcatccgcgtccgcggggatggacgtggactctaa

SEQ ID NO: 102 - DNA, 20 bp, Artificial sequence
  primer
agagtttgatcctggctcag

SEQ ID NO: 103 - DNA, 21 bp, Artificial sequence
  primer
acggctaccttgttacgactt

SEQ ID NO: 104 - DNA, 1376 bp, Ochrobactrum haywardense
ttgcagtcgagcgccccgcagggaggacggcagacgaggtgagtaacgcagtgggaatctaccttttgctacggaacaacagttggaaacgactgctaataccgtatgtgcccttcgggggaaagatttatcggaaaaggatgagcccgcgttggattagctagttggagaggtaaaggctcaccatggcgacgatccatagctggtctgagaggatgatcagacacactgggactgagacacgggccagactcctacgggaggcagcagtggggaatattggacaatgggcgcaagcctgatccagccatgccgcgtgagtgatgaaggccctagggttgtaaagctctttcaccggtgaagataatgacggtaaccggagaaagaagcccccggctaacttcgtgccagcagccgcggtaatacgaagggggctagcgttgttcggatttactgggcgtaaagcgcacgtaggcggatttttaagtcaggggtgaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgtcggggagtttactcttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacataccggtcgcggacacagagatgtgtctttcagttcggctggaccggatacaggtgctgcatggctgtcgtcagcttgtgtcgtgagatgttgggttaagtcccgcaacgagcgcaaccctcgcctttagtagccatcatttagttgggcactataaagggactgccagtgataagctggaggaaggtggggatgacgtcaagtcttcatggcccttacgggctgggctacacacgtgctccaatggtggtgacagtgggcagcaagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttctgcccgaaggcactgtgctaaccgcaaggaggcacgggacccatcggaggtaccccagggg

SEQ ID NO: 105 - DNA, 1318 bp, Ochrobactrum haywardense
gggagcggcagacgggtgagtaacgcgtgggaatctaccttttgctacggaacaacagttggaaacgactgctaataccgtatgtgcccttcgggggaaagatttatcggcaaaggatgagcccgcgttggattagctagttggtgaggtaaaggctcaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggatttttaagtcaggggtgaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgtcggggagtttactcttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacataccggtcgcggacacagagatgtgtctttcagttcggctggaccggatacaggtgctgcatggctgtcgtcagctcgtgtcgtgagatgttgggttaagtcccgcaacgagcgcaaccctcgcctttagttgccatcatttagttgggcactctaaagggactgccagtgataagctggaggaaggtggggatgacgtcaagtcctcatggcccttacgggctgggctacacacgtgctacaatggtggtgacagtgggcagcaagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttctgcccgaaggcactgtgctaaccgtaagg

SEQ ID NO: 106 - DNA, 38813 bp, Artificial sequence
  Synthetic construct
ttatacaaagttgatagattgtatgaattcatttacaattgaatatatcctgccattttacacctcgatatatcctgccacaaattccatgtacacagtacattaaaaacgtccgcaatgtgttattaagttgtctaagcgtcaatttgtttacaccacaatatatcctgccaccagccagccaacagctccccgaccggcagctcggcacaaaatcaccactcgatacaggcagcccatcagtccactagagggcccgccgagaatgaacgccaagaggaacaagcatgaaaccgcaccaggacggccaggacgaaccgtttttcattaccgaagagatcgaggcggagatgatcgcggccgggtacgtgttcgagccgcccgcgcacgtctcaaccgtgcggctgcatgaaatcctaggaaatatcagccgcttgtgtgttcaattcttctctgtttcacttgaaacaaattgaatagatattcccgctttcaaagccatttacaaatcctctcgtgcagcctaacgccattggcgtggaacaagcgttggcacgaggaagtaagtgcgatgaacggaaggtattcaccgacgcggcaggattttaagacaggcgcgaagccttggtctatattagcccttatcgttgccgcaatgattttcgcgttcatggcggttgcgtcctggcaggacaatgggactacccaggcaatccttagccaaatacgatcgattaacgctgacagcgcctcactgcagcgcgatgtactccgcgctcacacgggcaccgtggcgaactaccgccccattatctccaggctgggagctctgcggaagaatctggaagatttgaagcaattatttaggcaatctcatattgtaagtgagagcaatgctgctcaactgctacgccggctagaagtgtctctaaattcggctgacgcggcggtcgccgcctttggtgcgcaaaatgtccgcctgcaagattcgctggccagtttcactcgtgctttaagcaatcttccaggaaaggcctcaggcgatcagactttagaaaaaccaacagaattggctagcatgatgctccaatttcttcggcaaccaagcccggctatttcattcgagatcagccttgaactagagaggctccaaaaacaacgcggtcttgatgaagctcccgtgcgcatactttcgcgtgaaggtcccattatcttatcgcttttgccacaggtgaacgatctggtgaacatgattcagacgtctgacaccgcagaaattgcggaaatgttgcagcgtgagtgtttggaggtctatagcttgaaaaatgtggaggagcggagcgcacgtatctttcttgggtccgcttcagtgggtctttgcctgtacatcatcaccttagtctataggctacgcaaaaaaaccgattggttagcgcggcgtttagattacgaagagctaatcaaagagatcggagtatgttttgaaggtgaggcggccactacgtcgtccgcgcaagctgcacttggtattattcagcgcttctttgatgccgatacgtgcgcgttagctctagtggaccatgaccgtaggtgggctgtcgaaacattcggtgcgaagcacccaaaacccgtgtgggacgacagggtgctacgcgaaatagtctctcgtaccaaagcgaacgaacgggcgacggtattccgcatcgtatcgacgcaaaaaatcgtacatttgcctcccgaaattccaggtctttcgatactactggctcacaaatccacagataaactaattgcggtttgttcactgggttaccaaagctatcgccctcgaccttgccaaggcgaaattcagcttcttgaactcgccaccgcctgcctctgtcactatatcgatgttcggcgtaagcagaccgaatgcgacgttttggccagacgattggagcatgcgcaacgccttgaggcagttggtacacttgccggcggaatagcacatgaatttaataacattttggggtcaatcctcgggcacgcagaattggcccaaaactcggtgtctcgaacatctgtcacccgaagatacattgactatatcatttcgtcaggcgacagagccatgctcattatcgatcagatcttgacgctgagccgaaaacaagagcgcgtgatcaagccatttagtgtctcagagcttgtgaccgaaatcgctcccttgctacgtatggctcttcccccaaccatcgagcttagtttcagatttgatcaaatgcagagcgtgatcgaaggaagcccgcttgaacttcaacaggtactaattaacctctgcaagaatgcttcccaagccatgactgcaaatggtcaaatcgacatcttcgtcggccaagcttatttaccagctaagaaaattctggcgcatggtgttatgccacctggcgactatgttctactatctgtcagcgacaatggtggaggcatttcagaggctgtgctaccctacatttttgaacccttctttacgacacgtgctcgcaacggtggaacgggtctcggcctcgcttctgtgcatggtcatatcagcgcgtttgcaggttacatcgacgttagttcaactgttgggcatgggacgcgctttgacatttatctccctccgtcttctaaggagcccgtcaatcccgacagctttttcggccgcaataaggcaccgcgtggaaacggggagattgtggcacttgttgagcccgatgacctcctgcgggaggcgtatgaagacaagatcgccgctctgggatatgagccggtcggttttcgtacctttagtgaaattcgcgattggatttcaaaaggcaatgaagccgatctggtcatggtcgaccaagcgtctcttcctgaagatcaaagtcctaattccgtggatttagtgctcaagaccgcctccatcatcattggcggaaatgatctcaaaatgcccctttcaagggagaatgcgaccagggacctttatctgccgaagccgatatcgtccagaactatggcgcatgcaatcctaaccaaaatcaagacgtagagttgcgacgtatcaggactgggcaatcgcggccgccgggcttacgtgtcttttgtaacaaattgcgacgcagttgatatccacttgaaacattagtccgaaattatcgagatctccgctgataaggtatcgaaatggcgataaaattggtattgatactcgtattcacactctttcccgcggcagacgctgcatatgcgaatgaccgcgccaacggtttcatgtggtcaaacgggggcgaaactggagtgaggcttcctcttcgggtgttcaatgccaagccagccaagaacacggtggcgatcatttattccggagacgctggatggcaaaatatcgatgaggcgattggtacctatctgcagacggaagggattcctgtcattggcgtcagttcacttcggtatttctggtcggagcggtccccaagcgaaactgctaaggatcttggtcacataatcgatgtctacaccaagcatttcggtgtgcagaatgttttacttgtaggatattctttcggcgcggacgtcatgccggcaagcttcaataggcttacgcttgagcaaaaaaatcgggttaagcaaatctctctcttggcattgtcacatcaagtcgactatgtcgtctcatttaggggctggctccaactcgaaacggaaggtaagggcggcaatcctctggatgatctcagatccattgaccctgcaatcgtccaatgcatgtacgggcgcgaagaccgtaataatgcttgcccatctctccgacagaccggcgcagaggtgataggcttcagcggaggccatcactttgataatgatttcaaaaaactgtctacgcgcgtcgtctcaggcctcgtggcacgcctaagtcatcagtaatctttagttcctgcaccgcgggacccgcgaggtttctcgcttcaattgaaatcataaagaagcaattgaaaattttcgagtaaccgaccctcccgataatcttcaacataaaacaacgcacttcttccaacgggagaggcggtgttagttgcgagctaaggagataaggtatgcttaagagatcggggtcgctttctcttgccttgatggtctccttctgttcgtcgagccttgccacgccactctcatctgctgagtttgaccatgttgctcgcaagtgtgccccatcagttgcgacatctacgcttgcggcgatagctaaggtggagagtcgctttgatcctttagcgattcatgacaacacgaccggcgaaacgcttcactggcaagatcacagccaagcaacccaagtcgtcaggcaccgtctcgatgcacggcattcgctggatgttggcctcatgcaaataaactctcgaaatttttctatgctcggtctgacacctgacggtgcgctccaggcgtgcacatcattatctgccgctgcaaacatgctgaaaagtcgttatgcaggcggcgaaacgattgacgagaagcaatttgcgcttcgtcgggcgatctccgcttacaacaccggtaatttcatcggcggttttgcaaacggctacgtgcgaaaagttgaaacagctgctcaatcgctggtgcccgcgttaatcgagcctccaaaagacgatcacgaggcgctaaaatccgaagagacgtgggatgtttgggggtcatatcagcgccgctcgcaggaggatggcgctggcggtttaatcgctccgccaccgccacaccaggacaacggcaaatccgcagacgacaatcaagtcttattcgacttatactaaggaggtgcgcattgatgcgatgctttgagagataccgtttacatctaaatcgcctctcgctctcgaatgcgatgatgcgcgtgatatcgagctgcgccccaagcttgtgcggtgcaattgcatggagcatttcctcatccggacccgccgcagcgcaatctgcgggtggcggcactgaccccgccacaatggttaacaatatatgcacgtttatccttggtccgttcggccagtcactcgctgttctcggcattgtcgctatcgggatctcctggatgttcgggcgggcttcgcttgggctggttgccggcgtcgtcggcggcattgttatcatgtttggggcgagcttcctcggccaaacgctcactggcggtagttgatggctgatcgtttggaagaatcgaccctttacctcgcagccacacggcccgcattgtttcttggggtgccactgacattggcagggttattcatgatgttcgccggctttgtcatcgttatcgttcagaacccgctctacgaagtcgttctcgtgccgttatggtttgcagcccggctcatcgtggagcgagactacaatgcggcgagcgtcgtcctgctatttttgcggaccgcgggaagaagcattgatagtgcagtttgggggggcgctactgttagcccaaatccaattagggttcccccacgagggagaggaatggtgtgatgctcggcgcgagtggaacgaccgaaagatccggtgagatctatctcccttatattggccacctcagcgaccatatcgtccttcttgaagacggatcgatcatgaccattgcgagaattgatggcgttgcattcgagcttgaggaaactgaaatgcgcaatgcgcgttgtcgtgcgttcaacacgctgttgcgcaatatcgctgatgatcatgtgtcaatatatgctcacctcgtacgtcatgccgacgtgccatcatcggcgccgcgacacttccgtagtgttttcgccgctagcctgaacgaagcttttgaacagcgcgtgctctccggccaactcctccgcaatgaacacttccttacgttgattgtctacccacaggcggctttagggaaggtaaagaggaggttcaccaagctaagcggaaaaagggaaaacgatctcacgggccagatcaggaacatggaagatctttggcatgttgtcgctggctctcttaaagcgtatggcctgcatcgtcttggcatccgcgagaagcagggtgtgctcttcaccgaaattggcgaagcgctacggttgatcatgactggtcggttcacaccggttccggtcgtcagcggctcactcggcgcttcgatttataccgacagagtcatttgcggcaagcgaggactcgagatcagaacgccaaaagacagttacgttggatccatctattcgtttcgcgaataccctgcaaaaacacggccgggcatgctcaacgcgctgctatccctcgattttccacttgttctcacgcagagtttttcgttcctgactcgcccgcaagcgcacgcgaaacttagcctcaaatcgagccagatgctgagttccggcgataaagccgtgactcaaatcggcaaattatccgaggctgaggacgcacttgcgagcaacgaattcgttatgggctcacatcatttgagcctttgcgtctatgcagacgatctcaatagtcttggggacaggggcgcgcgggctcggacacgaatggcggatgcaggtgccgtggttgtccaagaaggtattggtatggaagcggcctattggtcccaattgccggggaattttaagtggcgcacacgccctggcgcaatcacttcacgcaatttcgcagggtttgtctctttcgaaaactttccagagggcgccagctcaggccactggggcaacgcgattgcccgatttcgtaccaatggcggaacgcctttcgactatatcccgcatgagcacgatgttggcatgacggcaatattcgggcctatcgggaggggtaagacgacgctcatgatgtttgttctagccatgctcgaacagagcatggtcgaccgtgcaggtacggtcgtgttctttgacaaggaccggggtggcgaattgctggttcgcgccacaggaggaacatatttggcacttcacagaggcacacccagcgggttggcgccgttgcgtggcctagaaaacacagcagcctcacacgattttctgcgcgaatggatcgtggctctcatcgagagtgatggtcggggtgggatttctccggaagagaaccgccgtctggtccgtggtatccatcgtcagctctcgtttgatccacaaatgcgttcaatcgcggggttacgtgaatttttgttgcatgggcccgccgaaggcgcaggagcgcggctccaacgctggtgccggggccatgcgcttggctgggcatttgacggcgaagttgacgaagtaaagttagatccgtcgattaccggcttcgacatgacgcatcttctcgaatacgaggaagtatgcgctcccgctgcagcatatctcctgcatcggattggagccatgatcgacggccgccgttttgtgatgagctgcgatgagtttcgcgcctatttgttaaaccctaaattttcgactgtcgtcgacaaattcctcctgaccgttcgaaaaaacaacgggatgctaatactggcaacgcagcaaccagagcatgttctggaatcgccgctaggagccagcttggttgcgcaatgtatgacgaagattttctatccatcaccaaccgcagatcgatcggcttatgtcgatggactgaaatgtaccgaaaaggaatttcaggcgatccgtgaagacatgacggtcggcagccgtaagtttcttcttaaacgagaaagtggaagcgtcatctgcgaatttgatctgcgggatatgcgtgaatatgtcgccgtgctttcggggcgtgccaacacggtgcgctttgcaactcgactacgcgaggcacaagaaggcaactcatctggctggctcagcgaattcatggcccgtcaccacgaggcagaagattgataaggtaggaaacgatgaagacgacgcaacttattgcaacagttttgacctgcagctttctatatattcagcccgcgcgggcgcagtttgttgttagcgacccggcaacggaggctgagacgctcgcgactgcgctcgcgactgcggagaatctcactcagactatagcgatggttacgatgttgacgtcggcctacggcgttactggactactgacttcgctcaaccagaaaaatcagtatccttcgacgaaggacctagacaatgaaatgttttcgccgcgaatgccaatgtcgaccacggcacgtgcgatcaccagcgatacagatcgtgcagtcgtgggtagtgatgctgaagcggacctgttgcgatcgcagatcaccggttccgcaaacagcgctggcattgcggctgacaatctggaaacgatggacaaacgcttgacggcgaatgctgatacgtctgctcagctttcccgatctcgcaatatcatgcaggcaaccgtgaccaatggtttgcttctcaagcagatccatgacgcaatgattcaaaatgtacaggcgacaagcctattaacgatgactaccgcgcaggccggccttcacgaggcggaagaggcggccgctcaacgcaaggagcatcaaaagaccgctgtcatctttggtgccctcccctaaggctgggcgatttgttcatccgcccgcatcctcgccgaatgcgagctcattttatccaacattatgcgacaaaccagtcaagttcaggtccaatcgatgaatttcacgattccggcgccgtttacggccattcatacgatcttcgatgtagccttcacgacaggcttggactcgatgcttgagactatccaggaggcggtgagtgcgccattgatcgcctgtgtcactctttggattattgttcagggtattttagtcatacgcggcgaagtcgatacccgtagcggtatcactcgggtgatcacggtcaccatcgttgttgctctaattgttgggcaggctaactaccaagactatgtggtttccatcttcgaaaagacggtcccaaactttgttcagcagtttagtgtaaccggcttgcctctgcagactgttccggcacagttggatacaatgttcgccgtgacccaggccgtttttcagaaaatcgcatccgaaatcggtccgatgaacgaccaggacatccttgctttccaaggggcacagtgggtcctttacggcacgctctggtctgccttcggagtttacgacgccgttggaattctcacgaaagtgcttctcgcgatcgggcctctgatcctcgtcggatatatttttgatcgcacgcgggacatcgcagctaagtggatcgggcaacttatcacctacggtctcttgcttctcctcttaaacctcgtggcaacgatcgtcatcctaaccgaagcgactgcgctcacccttatgcttggtgtaatcaccttcgccggtacgaccgcggccaagatcattggtctttacgaactcgatatgttttttctgacaggggatgcgctcattgtcgctttgccggcgatcgccggcaacattggaggcagttactggagcggcgcaacccaatctgccagcagcttgtaccgtcgcttcgctcaggttgagcgaggctaggtcgcgcaaaaattcgcctcaatggagaattctatgaagtattgcctgctgtgcctagttgtcgctttgagcggctgccagacaaacgacacattagcgagctgcaaaggcccgatcttcccgctgaatgtggggcgatggcagcctactccgtcagatcttcagctcggcaattcgggtggacgctatgacggggcctgaatatgccatgctagtggcgcgcgaaagccttgccgagcactataaggaagtagaagcctttcaaaccgcgcgagcgaaatcggcgcgacgtctctccaaactcattgcagctgtcgcagctatcgcgattttgggaaatgttgctcaagcgttcgctatagccacaatggtgccgttgagcaggcttgtgcccgtatatctatggatacggccggacggcaccgttgacagcgaggtgtctgtctcgcgattgcctgcaactcaagaggaggccgtcgttaacgcctcattgtgggagtacgttcgcctgcgcgagagttatgatgccgacaccgctcagtacgcctacgacctggtatcgaacttcagtgccccaacagtgcgccaggattaccagcaattcttcaactatcccaatcccagttcgcctcaagtcattcttggcaaacgcggcagggtggaggtcgagcacatcgcttcaaatgatgtaactccaagcacgcagcaaattcgctataaaaggaccctcgtcgttgacggcaaaatgcctgtggtgagtacgtggaccgcgacagttcgctacgaaaaggtgaccagcttgcccggcagattgagactaaccaacccggcaggtctggttgtcacctcctatcagacatcggaagataccgtttcaaacgtaggccacagcgaaccatgatcagaaaagcacttttcattttagcatgtttatttgccgctgcgactggtgcggaggctgaagacactccaatggcgggcaagctagatccgcgcatgcgttatttggcttacaatcccgatcaagtggtgcgcctctcgacggcggttggagctactttggtcgtaacattcgccacgaacgaaacggtgacagcggttgccgtttcaaatagcaaagatctagcagccctaccgcggggaaattatctatttttcaaggcaagccaggtcctcacgcctcagccagtaatcgtgctaaccgcaagcgactccgggatgcgccgttatgttttcagtataagttccaagactctgtcccacctcgataaagagcagcccgatctctattacagcgtccaattcgcctaccccgccgacgatgcggcggctcggcgaagggaggcacaacagaaggctgttgtggacagactacacgcggaagcacaatatcaacggaaagctgagaatttattggatcagcctgtcacagcccttggtgcggcggacagtaattggcactacgtcgcccaaggcgatcgttcgctgttgccactcgaagtcttcgacaatggatttacgacggtattccactttccgggcaatgtacgcataccctccatctacaccatcaatcctgatggcaaggaagctgttgccaactattcagttaaagggagcgatgtcgagatttcttcggtttcccgaggttggcgtctgagggatggccacacagtactatgtatctggaacaccgcttacgatcccgttggccaaaggccgcaaacgggcacggtgaggcccgatgtgaaacgcgtcctgaagggggcgaagggatgaataacgatagtcagcaagcggcacatgaggttgatgcatctggatccctggtctccgacaaacatcgccggcgtctttcggggtctcagaaattgatcgtcggaggtgtcgttctcgcgttatcattaagcctcatttggctaggtgggcgccaaaagaaggtgaatgagaacgcatcgccgtcaactttgatcgcaacaaacaccaagccatttcatccagctccgattgaggtgccgccggatcctccagcggttcaagaggctgttcagcctgctgctcctctaccgccgaggggcgaaccggagcggcatgagccacggccggaagaaacaccgatttttgcatatagcagcggcgatcaaggggtcagcaaacgcgccattcagggcgacacgggccgaagacaagaaggcaagcgtgacgacaactccttgccgaatggcgaagtgtccggcgagaacgatttgtcgatacgtatgaaacccaccgagctgcagcccagcagcgccacgctcttgccgcaccccgattttatggtaacgcaagggacaataattccgtgcatcttgcaaaccgcaatcgacacaaatttggcaggctatgtaaagtgtgtcttgcctcaggatattcgtggaacaacgaacaatatcgtgcttcttgatcgtggcaccaccgttgttggcgaaatacagcgtggcttgcaacagggagatgggcgcgtttttgtgttgtgggatcgcgccgagacacctgaccatgcgatgatctcgttaacatcgccaagcgcggacgaactcggtcgctcaggattgccgggctcggtcgacagccacttctggcagcgttttagcggagctatgctcttgagtgttgttcaaggcgccttccaggcagctagcacctacgccggcagctcgggtggcgggatgagcttcaacagctttcaaaataacggtgagcagacaactgagacagcccttaaggcaaccatcaacataccgccaaccctgaagaagaatcagggtgacaccgtttccattttcgtagcacgggacctcgatttctttggtgtttaccagctccgcctgactggcggcgccacgcgggggaggaaccgccgctcttaatgaattcaaatttccgcttagagataggatacattgtaaatggaagtggatccgcaactacgctttcttctgaagccgattttggaatggctcgatgacccgaagactgaagaaattgcgatcaatcgacctggagaggcatttgtgcgccaagccggcatttttaccaagatgcctttgcccgtctcttatgatgatcttgaagatatcgctattttagcgggcgcgctgagaaagcaggatgtcggaccacgtaaccccctctgcgccactgaacttcctggtggtgaacgactacaaatctgtctgccgccgaccgttccctcgggcaccgtcagcttgaccattcgacggccaagctcgcgtgtttctggtcttaaagaagtctcctcccgttatgatgcttcgaggtggaaccagtggcagacacgaaggaaacgccaaaatcaggatgatgaagctatccttcagcattttgacaacggggatttggaagcgtttctgcacgcatgcgtcgtcagccgactgacgatgttgctatgtggccctaccggaagcggcaagacaacaatgagcaagaccttgatcagcgccatccccccccaggaaaggctaatcaccatagaagatacgctcgaactcgtcattccacacgataatcatgttagactactctactccaagaacggtgctgggctgggtgctgtgagcgccgagcacttgctccaagcaagtctgcgtatgcggccggaccggatattgcttggcgagatgcgcgacgatgcagcatgggcttatctgagtgaagtcgtctcgggacatccgggatcgatttcaacaatacacggcgcgaatccaatccaaggattcaagaaactgttttcccttgtcaaaagtagcgcccaaggtgctagcttggaagatcgcacactgattgacatgctctctacggcgatcgatgtcatcattccattccgtgcctatgaggacgtttatgaagtaggcgagatctggctcgcggcggacgcacgacgccggggcgagaccataggcgatctccttaatcaatagtagctgtaacctcgaagcgtttcacttgtaacaacgattgagaacttttgtcataaaattgaaatacttggttcgcattttcgtcatccgcggtcagccgcaattctgacgaactgcccatttagctggagatgattgtacatccttcacgtgaaaatttctcaagcgctgtgaacaagggttcagattttagattgagaggtgagccgttgaaacacgttcttcttatcgatgacgatgtcgctatgcggcatcttattatcgaataccttacgatccacgccttcaaagtgaccgcggtagccgacagcacccagttcactagagtactctcttccgcgacggtcgatgtcgtggttgttgatctaaatttaggtcgtgaagatgggcttgagatcgttcgaaatctggcggcaaagtctgatattccaatcataattatcagtggcgaccgccttgaggagacggataaagttgttgcactcgagctaggagcaagtgattttatcgctaagccgtttagtacgagagagtttcttgcacgcattcgggttgccttgcgcgtgcgccccaacgttgtccgctccaaagaccgacggtctttttgttttactgactggacacttaatctcaggcaacgtcgcttgatgtccgaagctggcggtgaggtgaaacttacggcaggtgagttcaatcttctcctcgcgtttttagagaaaccccgcgacgttctatcgcgcgagcaacttctcattgccagtcgagtacgcgacgaggaggtttacgacaggagtatagatgttctcattttgcggctgcgccgcaaacttgaggcggatccgtcaagccctcaactgataaaaacagcaagaggtgccggttatttctttgacgcggacgtgcaggtttcgcacggggggacgatggcagcctgagccaattgcatttgattaatttaggtgactgaggacgcggccagcggcctcaaacctacactcaatatttggtgaggggttccgataggtccctcttcaccaattgctcgatggcttctctccagcaaagaatgacgcgagcgcggcggtagccagcttgtggccgaaagctcgagcggtctccaaccccaacggatcaaaatgacttcgagcgacctcgagcaacgcaaccgggaacatgcgtgaggtctgaacgagaacggatttttctgtagttgaagggatcggataacttttcggggccacgcgaaatgatccatctgccagcatgctttcgaaatcgtccaacgcgcgccttaaaatcatttgtagcgacttcgagggactgtattgccgaacgaggttgtcatatgttttcgacacttgaggcgcgggcggtcgcgctgaaagaaaaacctggagctttttcggggacggaggtggactaagggcatccacagttagcttaagttgtcgatcgggactgtaaatgtgatcggcgacgagaggctcacgttgctggtctttctcgtcggctttttcaggcaagtgctggaggtccagcttctggggaacaagtgtcgggttgggatggtggatctcgggtcgagcaccagcaagccgccgtgcttcgccgaccgacaatgcgggcttgcgaattgccatcttcaagcctccaagattttgctgatcagtttcgaaatgaccacgacttcctccatcgcaatccgaagattcctctctatgaggcgcatcgtcggatcagttcccgtgtttagtaatgtaagatgcaacatgccgcgttctttcatcgcggcaaatgcatctctttcatgcatgggagacggtacaactggaaggctctctagcgtctctgacatcctgcgttgcgatgttgtcaatcggccgaccgggacgcgttggcgcaaaacagctgtaggaattgccaaattttcactcaacagcagctcgatgacgtagcggtaggtagatagtgcctcatcgatgtcgagcggcgttagcatggtggggatcagaagcaggtttgagctagcgatgattgtgttgttgagctcgctcgagccgccacgcgtatcggccaacgcataatcaaatccttcgagctcggcattttcataggctgcttcaagaaggggcatttcgtcggcggaatagacttcacagcgaggatcccaggtactgctttgtaaggcgttttctctccatcgcgtcagaggccggttttcgtcggcatcaaagagggccactcgtttaccgtcatttgccaaagcagcgcaaaggcccatgagtgcggtggttttgccagcaccccctttgaaagaacaaaacgtcaaaagttgcatattctgatcccgcctatcctgtgaaaccggagtgcatttgtatttttgttcgtataaatgtttttgtgattatcgatgagtaaaagcgttgttacactatttttatttcacattcgttataagacaattgcaaatgtagcaagtatattcagtattgactgtaaatgtactgttgatttcatattgagcagggctagacttccatccgtctacccgggcacatttcgtgctggagtatccagaccttccgctttctttggaggaagctatgtcaaaacacaccagagccacgtcgagtgagactaccatcaaccagcatcgatccctgaaagttgaagggttcaaggtcgtgagtgcccgtctgcgatcggccgagtatgaaaccttttcctatcaagcgcgcctgctgggactttcggatagtatggcaattcgcgttgcggtgcgccgcatcgggggctttctcgaaatagatgcagacacacgagaaaagatggaagccatacttcagtccatcggaatactctcaagcaatgtatccatgcttctatctgcctacgccgaagaccctcgatcggatctggaggctgtgcgagatgaacgtattgcttttggcgaggctttcgccgccctcgatggactactgcgctccattttgtccgtatcccggcgacggatcgacggtcgctcgttactgaaaggtgccttgtagcacttgaccacgcacctgacgggagaaaattggatgcccgatcgcgctcaagtaatcattcgcattgtgccaggaggtggaaccaagacccttcagcagataatcaatcagctggagtacctgtcccgaaagggaaagctggaactgcagcgttcagcccggcatctcgatattcccgttccgccggatcaaatccgtgagcttgcccaaagctgggttacggaggccgggatttatgacgaaagtcagtcagacgatgacaggcaacaagacttaacaacacacattattgtaagcttccccgcaggtaccgaccaaaccgcagcttatgaagcaagccgggaatgggcagccgagatgtttgggtcaggatacgggggtggccgctataactatctgacagcctaccacgtcgaccgcgatcatccacatttacatgtcgtggtcaatcgtcgggaacttctggggcaggggtggctgaaaatatccaggcgccatccccagctgaattatgacggcttacggaaaaagatggcagagatttcacttcgtcacggcatagtcctggatgcgacttcgcgagcagaaaggggaatagcagagcgaccaatcacatatgctgaatatcgacgccttgagcggatgcaggctcaaaagattcaattcgaagatacagattttgatgagacctcgcctgaggaagatcgtcgggacctcagtcaatcgttcgatccatttcgatcggacgcatctgccggcgaaccggaccgtgcaacccgacatgacaaacaaccgcttgaaccgcacgcccgtttccaggagcccgccggctccagcatcaaagccgacgcacggatccgcgtaccattggagagcgagcggggtgcccaaccatccgcgtccaaaatccctgtaactgggcatttcgggattgagacttcgtatgtcgctgaagccagcgtgcccaaacaaagcggcaattccgatacttctcgcccggtgactgacgttgccatgcacacagtcgagcgccagcagcgatcaaaacgacgtcatgacgaggaggcaggtccgagcggagcaaaccgtaaaagattgaaggccgcgcaagttgattccgaggcaaatgtcggtgagcccgacggtcgcgatgacagcaacaaggcggctgatccggtgtctgcttccatccgtaccgagcaaccggaagcttctccaacgtgtccgcgtgaccgtcacgatggagaattgggagaacgcaaacgtgcaagaggtaatcgtcgcgacgatgggcgcggggggacctagactagtagacaggaaggaccgaataatggcaaatggtcagttcacgatacgctctgctcgcccggcctccgtcggactgacaggcgaacggcgtggagccgcatccgcctctagctctgcactgtccaatgttcaaagagatgttagggataggctgattccaactagctcaccaagattaccaaatgcagccatattgcgtgattcctcgggaagagcgtcgactggtctgcggtacatggcggctactcttcattggtctgcgatcgcgccattatcgctaataaacagcaacgacctggctccggccgcttatgactttgagacgcgaaataacgcaagaaatgtgactgccaaagtcggcagggcagtccctgttcccaagcaaggcgggctcggcaaaacgctcgcacccgtaccccttagtacacgtatatcaagggtcaattccgaccgaagactgcccgctgacgcagaagaccgccctgaaacgcgcgacccccagaaaggacgtggcagtcatggtgcgacgccaaccttacatgaaaagattggaaccgcgtttgctcgaagattgcgaaagcatacgtactatattgtttgcagttgctgccagacccggagcgcgttgacgatgggtgcaaagatttcggtgaagtcatgaactccagcaagacttcgccccagcgtatgaccctgagcatcgtatgttcgctggcagccggtttttgtgcggccagctgctatgtaacgttccgccggggcttcaacggcgaagcgatgatgacgttcgacgttttcgctttttggtatgagaccccgctttacttgggttatgccagcaccgtcttctggcgtggtttatctgttgtcatctttacctcgctgatcgttctttcaagtcagctcatcatatcgctgcgcaatcagaagcatcatgggacagctcgttgggcagaaattggcgaaatgcggcatgctggttatctgcagcgttacagtcgcatcaaggggccgatctttggaaagacatgtggtcccctttggttcggcagttatttgaccaatggcgaacagccacacagtcttgtcgtcgcgccaacgcgtgctggcaaaggcgtcggcatcgtcattccaacgctgttgaccttcaagggctcggtaatcgcccttgacgtcaagggagaattgtttgaactgacgtccagagcacgcaaagcgagcggcgacgcagttttcaagttctcccccctagatcctgagcggaagactcattgttacaatccggtcctggatattgccgcacttccgcccgaacgccagttcactgaaacacgccgtctagctgcgaaccttattacggctaagggaaagggagcagaaggctttattgacggcgcacgtgacctgttcgtcgcgggaatccttacctgcattgagcgtggcacaccaacgattggcgcggtatatgacctatttgcgcagcctggcgaaaagtataagctttttgcgcaactcgcggaggaaagcctaaacaaagaggctcagcgtatcttcgataatatggcgggcaacgacacgaaaattctgacatcgtacacctctgtgctgggcgacggtggactgaacctgtgggctgatccgcttatcaaagcagcgacaagccggtcagacttttccgtttacgatctccggaggaagaagacctgcatttatctttgtgtcagtcccaacgatctggaggtcttggcaccacttatgcgcctgatgtttcagcagctcgtgtcaatcttgcagagatcgctgccaggtgaagacgagtgccatgaagttttatttctcctcgacgaattcaaacacctgggcaagcttgaggccatagagaccgcgatcacaaccatcgccggttacagaggccgctttatgtttattattcaaagtctttcggccttgtcgggcacatacgatgacgcaggaaaacaaaactttctgagcaatactggcgtacaagtatttatggccacggctgatgacgaaactccaacctacatctcaaaagctatcggcgaatatacgtttaaagcgcgttcgacctcttacagtcaagccagaatgttcgaccacaacatccagatttctgatcaaggtgcagcccttttgcgccccgaacaagtgcgcctgctagacgatcagagtgaaatcgttctcatcaaagggcgacctccactcaaattacgaaaggtgcagtattattccgatcgtacgctgaaaggccttttcgaacgccagatgggctctctgcctgagcccgcacccttgatgctttccgactatagcaacgatcaagttcaataccacttggctccgatagcaaattttaatgaggatgctgcaccgcaaaacagaactgtggccgaggaccatggaagtgttaaagtcggtgctgatatccctgaacgcgtgatgggaataaatggtgacgaggaacaagccgatgcgggcgagataccgccggaatcggttgtgcctccagaattgacgctcgctctgaccgctcaacagcaattgttggaccagattattgcacttcagcaaagatcgaggtccgcaccggcatagcctgcgaaatgatcttaatggtgcaattcgtttcaggcggcatgttgcggttcaacaaagtgtacgccagatcccaattggccctttacgaggtgtcggtatgacaggaaagtcgaaagttcacataagaggttcggctgacgcgcttcctgacgttcctggcggaagtactaccgccccttttttaaccgaaccttctcgggatcaggttgatgcctcgtttgaggtccaaaccgactacagccagtctacttccgtgtcgtttacctatgatggtgttggacttggtcctgccgagcgtgcggcttacgagaactggtgcgaaccgggccggcccacttggaaagatcttataatcaaggcacgtgtcgatccgattgacgatgtgacctggctccgagatttagaagaggacaccccctcaaccttcagatacgaagggatgcctctgggcatcggggaacgacaggcctacgaaaattggcaagaggacgctcagccgacatgggaagaccttgttgtcagcgcacgcttgacggaacttggccgtccacacgggattaccggcgagtatacatccctcgcaggatcgaagaatacaagttcaatttcattgaagcgaaagcggagcaacttaattgatgatgagaattcatccggatcgttttcatatgacgggatgaagctcggggaagccgagcgttctgcatatggtgactgggccgaggcggagccacccacgtggaaagatttggtattgagggcacgcgtttcctcgatcaatgactctgcttggctttttgattcacaaacatcttcatcatcatttgaatacaacggtgttcccttgggcgagccggaacggcaggctctcagacaatggcaaggagacgctcagcctacctgggaagatctcgttgttaacgcgcgtatggcagaactttgccatgctggttggattgaaggtcaaaaaggttgctttgaagagcgcggggaggctctgcccgcgtcggaacgcggttcgcaacgccccattggtcaacggacagattcctccgattcttttgtgtatgatggcacaaggctcggagcacctgagcgaactgcttatgaacgctggagtaagagggaacgcccgacttgggaagatctcatcttagatgcacaccaggccaggactgaaagtgacgctgttacgacccaagcgattggtcagtcgtcctcaccggttttcttatatgaaggaaagtcgctcggagacagggaacgaaaggcttacgaaaaatggcggcagccagcccaaccgcgatggcaaaatcttgtagtgaacgctcgtctggcagaaatcgatccctcagcctggattgccgatgagcgcgatccgcttgatgatagcgacgcgcttggtcgcccgtcgtacacaagcttgacggatagatcagacgtccctttagacgatcaatcaatctatcgtcgttccgacctagtaagggagcaggtgccagaatcgtctcaaaggcaattcgcagcatgttcagaatctgaaacgaggcctgtgcaatggtttactgcttctgggtcagatgcaaacaatacggaaaatatcaccgccagcgatcccgtcgatcgcacgggtggagttaagcggctaggctccaaaagcgacagaaccgttacagcttctatccatgacgtgaattccagcacaaggcgactgttgcttaacgaatttggatcggaggctccgcgcccttcgccagaaaagactgttcgcttaagaagcgacaatattggcacctatgggagccggaaaaatgaacgagcgcggctcgcgaccgaaaccggtgcgtatgagtcggagcatattttcgggttcaaggctgtccacgatactgcgagagcgacgaaagagggccggcgtctcgaaaggcccatgcccgcctaccttgaggataaggggcttcatcgccaacatattggcaccgggagaggacggaccaaacttgtcgggcgcggatggccggatgacacaagctatcgctcggatcaaagggcaactctgtcggaccccgttgcgcgctcggaaggcgcgacggcctcaaatgggtatcaattgaaccaattgggttacgcgcaccaactcgctagcgatggcctgcaaagtgaatcgcccgatggtgttgccttgccaattcaagtggcaacaacgagctacaactatacagtgagccgcgatcctgtccttgttccgccggataaaaacgaagcccctcaattgctgcatcttggtccccgtggtcaaaccgaagctgttcttgcccgcgaaacagcattgactggaaaatggccgactctcgagcgtgagcagcaagtgtatcgcgagtttttggccttatatgacgtaaaaaaagatcttgaggccaaatcagtcggcgtaagacggaaaaaaaaagaagttatttctgcgttagaccgaactgcgcgcttgataagcacgtcgccttcgaaagctcgatccaaagcagagactgaaaaagccattgatgagctcgatgatcgacgagtttatgatccgcgtgatcgagctcaagacaaagcgtttaaacgctgataagtcgccaatatagtgatcatttgcagtattcgcatcgatcgctggttgatattctgccgctggtcgaccggctgctcgtcgccaaaaatgctcacagggatacgatggcctcggtcaggccgcgtgcgtcctgtctttccagttcctccctttcagctcgattgtggcatcatttattgcctgctcattgcagttgaaacgcgatatccgtttcaagacccgggtatggatggtactttggagatatgagcacttgccagacttcccggtcggagacttaaaaattccgataagaggttacggacgacggaccttataagtggatcgtctagtggtggcgccgatcaaaacagttccgcccccggctttgctcaaagtagcaaagcagctttatctcgggttgcggaggattttctagaaaaccgcaattttgcaggagagaacatatggccatcatcaagccgcatgtgaacaaaaataggacaacctcgccgatagagagaccggagtctctcatagaggaaatgagcggcagtcatccgccgagtggttttaccaacctggatctcgctatgatcgagctggaggactttgtccatcggtgcccgctcccagaagacaatcttgctggtcagaaggagtgagacgatggatccgtctagcaatgagaatgtctatgtgggtcgcggtcacaacatcgaaaatgatgatgacactgaccccaggcgttggaagaaggcgaatatcagttccaacaccatctccgatattcagatgacgaatggcgaagacgtacaatcagggagccctacccgaacggaagttgtaagcccacgtctggattatggatcggtcgactcctcctccagcctttattctggcagcgagcacggaaatcaagctgagattcaaaaagagctgtccgtcttgttctcgaacatgtctttgccaggcaacgatcggcgcccggacgaatacattctcgtgcatcaaacgggacaagatgcttttactggtattgccaaaggcaacctcgaccaaatgcccaccaaggcggaatttaacgcgtgctgccgtctctacagggacggagccggtaattactacccgccacctctcgcattcgacaagattagcgttccagagcaactggaggaaaaatgggggatgatggaggcgaaggaacgtaacaaactgcggtttcagtacaagttggacgtatggaatcatgcgcacgctgatatggggatcacgggcacagagatcttttatcaaacagataagaacataaagctcgaccggaattataaactaagacctgaagaccgatacgtacaaacagaaaaatacgggcgccgggaaattcaaaagcgatatcaacacgaactccaggctggttcgctgctgcccgatattatgatcaaaactccccaaaatgacatccacttcgtgtacaggtttgccggcgacaattacgccaacaaacagttcagcgagtttgaacacaccgtcaagcgcaggtatggcgacgagactgagatcaaattgaagtcaaagtcaggcattatgcatgactcgaaatatctggaatcctgggaacggggcagtgcggatattcgcttcgcggaattcgttggggaaaatagagctcacaatcggcagtttccaactgcgacagtaaatatgggacagcagccagacgggcagggcggtttgacccgcgaccgtcatgtgagcgttgacttcctaatgcaaagcgcacccaattcgccttgggcgcaagctttgaaaaagggagaactgtgggatcgcgttcagttgcttgctcgcgacggcaaccgctatctgtcgccgcccagattggaatattctgaccctgcacatttcaccgagttgatgaaccgggttggtttacccgcatcgatgggtcggcaaagccatgcggctagtatcaaattcgaaaagtttgacgcgcaggcagcggttattgtcttaaatggcccagagttacgtgacattcatgacttgtctcctgaaaaactgcaaaatttgtccaccaaagatgtcatcgtcgccgatcgcaatgagaatggtcagagaactggcacgtacaccagcgtcgcggaatatgagcgcttgcagttaaggctgccacccgatgcagcgggggtgcttggtgaagcaactgacaaatattcacgtgatttcgttcggccagagccggcgtcgcgtccaatcagtgacagccgcaggatatacgaaagtcgaccgcgtagccaaagcgtcaacagcttttgacgttcctgctgccgcgtcaacgaggaagctcgtttgacccgggtttgccaatgaaagggctcaatcatggtgaacactacaaagaaaagttttgcgaagtcgcttacggcagatatgcgccgttctgctcagcgcgttgtcgagcaaatgcgaaaagcattgattaccgaagaagaggcgctcaagcggcaagccagactggagagtcccgataggaagcgaaagtatgctgctgatatggcgatagtcgacaaactcgacgtagggtttcgaggcgaaataggctataaaattcttggaaataaccggcttcgagtagacaaccataaagaattaacgcgtgagcacggtagacttcgcaaaaccaaaacggttctgaagcgtaacccggtgacgcaggaagtctatttgggtttatatgaaaggaagtcctggttaagtgtcagcagccatttgtatgctgcggacggcacactccgcatgaagcacgtgaaatacaaagacggacgttttgaggaaaaatgggagcgcgacgaaaatggcgacctgatccgcacaaggtacgccaaccgtggcaggctctttcaacctgtatccgagaaaatgggcgcgccgtatcggagcggccctgacgaccggctctatcgcgatctaacccgtcgaaacggtttcagacgggagacattcgaacgggacgatcacggaaacctcgagcgtatcggcagcaaccatgtcggcttttccaagatttcagtgaaggcacccaatcgtcaaacctcccagacgaagattcaaaaacttggtggcgctttcaacaaatcttttaggtcccttctggacaaggagggcaatgaaatgggccgcgatattttgagccatcgacggctctataacaagcggtctgctgtctacgatgaagctaccggacaattgaagagtgccaagcataccttcggcaagatctacaggagcgaaaccgaatatctcagcgcgggcctcaagaaggtttcaaaaaagatactcggggtgacggtctaccggaaatttgcggcgctcagcgagcgagaatccgaggctgagagactgcgtagttttgaatccggtgcgcatcgccagatctggcaggagcgggcagcgattcccggttcgcccctcccggagactgatgacattcatttcgcacagcagtcgcacctagccaaagccaaccctgatcacgtcgaagctgacgtcacgcgtgtgacagatcaacatgttgatgttgctggacaaacatcatcgtctccccaacggaacttggaaggatggttagattctcaatcacgatacaagccagcaaacatgctgttgtcaaatccagaccttcaagcgaacggacctcgcccatacgaagggttagctcatctcaccctccggcgcgataatgaatctgacgggcacaaggagaatgatcagcggctgcgacatttctcccagccagagccgttggtgttaccgcatcccgggtcgccggaaataactaaggtgtttggctcgcggggagagccggcacacccgagtggaaatctgcacacggcggttggagaaacggcttgcgaaggaccggtgatgtcttcatcctcggacaatcatcagccagctccaggacagcaagaacttttaagtttccttcataatgcgccagccccagtttctgtggcaatacatgatgatcaagagcgacttgcgggggaggcgcccggcggctctttcagaggtagctcagggcgaacgagttcaatgtcggagagtatcttcgacgaagatgtacaagggcatttggtacgggattattcgatcaatactactaacgggtttattgacccgcaatcgttgttcggtgaaccggacttatcgagaggtccaaaatcggggccagaaattccatcggaagattaccatttgtcagcttcggaacaggaaaatttgctgaatcaattgcttagtgtgccactgccggttccttcaccgaagcccgaatgcgcgaggtctatgattttcgaaggttcacgttcaagagagcgttccacctccagagggttctaaggtggaacgcgtctaggcttgcctatcatcaccacctcatgatggtcgcggagaccttcgaagagatatccgacatcattggagaagctgggccggaaactagtgtacctcgcgaatgcatctagatccaatccaatatgcatggcatgccgaatccatgtgggagtttattcttgacacagatatttatgatataataactgagtaagcttaacataaggaggaaaaacatatgttacgcagcagcaacgatgttacgcagcagggcagtcgccctaaaacaaagttaggtggctcaagtatgggcatcattcgcacatgtaggctcggccctgaccaagtcaaatccatgcgggctgctcttgatcttttcggtcgtgagttcggagacgtagccacctactcccaacatcagccggactccgattacctcgggaacttgctccgtagtaagacattcatcgcgcttgctgccttcgaccaagaagcggttgttggcgctctcgcggcttacgttctgcccaagtttgagcagccgcgtagtgagatctatatctatgatctcgcagtctccggcgagcaccggaggcagggcattgccaccgcgctcatcaatctcctcaagcatgaggccaacgcgcttggtgcttatgtgatctacgtgcaagcagattacggtgacgatcccgcagtggctctctatacaaagttgggcatacgggaagaagtgatgcactttgatatcgacccaagtaccgccacctaataatgtctaacaattcgttcaagccgacgccgcttcgcggcgcggcttaactcaagcgttagatgcactatacgtaccaatccaaatcggatccccctgcagggctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagcagatctatcgatggtacctatctgcagacggaagggattcctgttaattaaaacagcttgcgtcatgcggtcgctgcgtatatgatgcgatgagtaaataaacaaatacgcaaggggaacgcatgaaggttatcgctgtacttaaccagaaaggcgggtcaggcaagacgaccatcgcaacccatctagcccgcgccctgcaactcgccggggccgatgttctgttagtcgattccgatccccagggcagtgcccgcgattgggcggccgtgcgggaagatcaaccgctaaccgttgtcggcatcgaccgcccgacgattgaccgcgacgtgaaggccatcggccggcgcgacttcgtagtgatcgacggagcgccccaggcggcggacttggctgtgtccgcgatcaaggcagccgacttcgtgctgattccggtgcagccaagcccttacgacatatgggccaccgccgacctggtggagctggttaagcagcgcattgaggtcacggatggaaggctacaagcggcctttgtcgtgtcgcgggcgatcaaaggcacgcgcatcggcggtgaggttgccgaggcgctggccgggtacgagctgcccattcttgagtcccgtatcacgcagcgcgtgagctacccaggcactgccgccgccggcacaaccgttcttgaatcagaacccgagggcgacgctgcccgcgaggtccaggcgctggccgctgaaattaaatcaaaactcatttgagttaatgaggtaaagagaaaatgagcaaaagcacaaacacgctaagtgccggccgtccgagcgcacgcagcagcaaggctgcaacgttggccagcctcgcagacacgccagccatgaagcgggtcaactttcagttgccggcggaggatcacaccaagctgaagatgtacgcggtacgccaaggcaagaccattaccgagctgctatctgaatacatcgcgcagctaccagagtaaatgagcaaatgaataaatgagtagatgaattttagcggctaaaggaggcggcatggaaaatcaagaacaaccaggcaccgacgccgtggaatgccccatgtgtggaggaacgggcggttggccaggcgtaagcggctgggttgcctgccggccctgcaatggcactggaacccccaagcccgaggaatcggcgtgagcggtcgcaaaccatccggcccggtacaaatcggcgcggcgctgggtgatgacctggtggagaagttgaaggcagcgcaggccgcccagcggcaacgcatcgaggcagaagcacgccccggtgaatcgtggcaagcagccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggcaggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctagctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagccgaagagctgcaaaaagcgcctacccttcggtcgctgcgctccctacgccccgccgcttcgcgtcggcctatgcatataattgtggtttcaaaatcggctccgtcgatactatgttatacgccaactctgaaaacaactttgaaaaagctgttttctggtatttaaattaaaaatgaagcgtacgttggaatcgcttctacaaaactcacagaaacaatcaaacaaacatacacagcgatttattcacacgaacccgaattacaacggtatatatcctgtcagccaacaccaaaacatcaaaaaaatcgggatcaggatcaggatctgcggccgcatcctgcaggtcgactctagaggatcctcatcgctatcaactttgtatagaaaagttgggccgaattcgagctcggtacggccagaatccggtaagtgactagggtcacatcgaattcccataggattggggccagaatggccgcggccgcatcaggatattcttgtttaagatgttgaactctatggaggtttgtatgaactgatgatctaggaccggataagttcccttcttcatagcgaacttattcaaagaatgttttgtgtatcattcttgttacattgttattaatgaaaaaatattattggtcattggactgaacacgagtgttaaatatggaccaggccccaaataagatccattgatatatgaattaaataacaagaataaatcgagtcaccaaaccacttgccttttttaacgagacttgttcaccaacttgatacaaaagtcattatcctatgcaaatcaataatcatacaaaaatatccaataacactaaaaaattaaaagaaatggataatttcacaatatgttatacgataaagaagttacttttccaagaaattcactgattttataagcccacttgcattagataaatggcaaaaaaaaacaaaaaggaaaagaaataaagcacgaagaattctagaaaatacgaaatacgcttcaatgcagtgggacccacggttcaattattgccaattttcagctccaccgtatatttaaaaaataaaacgataatgctaaaaaaatataaatcgtaacgatcgttaaatctcaacggctggatcttatgacgaccgttagaaattgtggttgtcgacgagtcagtaataaacggcgtcaaagtggttgcagccggcacacacgagtcgtgtttatcaactcaaagcacaaatacttttcctcaacctaaaaataaggcaattagccaaaaacaactttgcgtgtaaacaacgctcaatacacgtgtcattttattattagctattgcttcaccgccttagctttctcgtgacctagtcgtcctcgtcttttcttcttcttcttctataaaacaatacccaaagagctcttcttcttcacaattcagatttcaatttctcaaaatcttaaaaactttctctcaattctctctaccgtgatcaaggtaaatttctgtgttccttattctctcaaaatcttcgattttgttttcgttcgatcccaatttcgtatatgttctttggtttagattctgttaatcttagatcgaagacgattttctgggtttgatcgttagatatcatcttaattctcgattagggtttcatagatatcatccgatttgttcaaataatttgagttttgtcgaataattactcttcgatttgtgatttctatctagatctggtgttagtttctagtttgtgcgatcgaatttgtcgattaatctgagtttttctgttaattaacagatggcctcctccgagaacgtcatcaccgagttcatgcgcttcaaggtgcgcatggagggcaccgtgaacggccacgagttcgagatcgagggcgagggcgagggccgcccctacgagggccacaacaccgtgaagctgaaggtgaccaagggcggccccctgcccttcgcctgggacatcctgtccccccagttccagtacggctccaaggtgtacgtgaagcaccccgccgacatccccgactacaagaagctgtccttccccgagggcttcaagtgggagcgcgtgatgaacttcgaggacggcggcgtggcgaccgtgacccaggactcctccctgcaggacggctgcttcatctacaaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcaggtgaagttcatcggcgtgaacttcccctccgacggccccgtgatgcagaagaagaccatgggctgggaggcctccaccgagcgcctgtacccccgcgacggcgtgctgaagggcgagacccacaaggccctgaagctgaaggacggcggccactacctggtggagttcaagtccatctacatggccaagaagcccgtgcagctgcccggctactactacgtggacgccaagctggacatcacctcccacaacgaggactacaccatcgtggagcagtacgagcgcaccgagggccgccaccacctgttcctgtagcggccaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccggccagaatggcctcaagtttgtacaaaaaagcaggctccggccagaatggcccggaccgggttaccgaattcgagctcggtaccctgggatccgatatcgatgggccctggccgaagcttggtcacccggtccgggcctagaaggccgatctcccgggcacccagctttcttgtacaaagtggccgttaacggatctggccgcggccgggtgattgcggttacatcatgtacggaaaaataattctaatccttgatttaaatttgaacttgactatttatttattctttatttcattttgtaaatcattttatgtatctcctggcaagcaattttatccaccttgcaccaacaccttcgggttccataatcaaaccaccttaacttcacaccatgctgtaactcacaccgcccagcatctccaatgtgaaagaagctaaaatttaataaacaatcatacgaagcagtgacaaaataccagatggtattaatgcttcgataaaattaattggaaagtataaaatggtagaaaataataaattataattaatttaagtaagataaaaaataattaaaaactaaaatgttaaaattttaaaaaaattattttaaataatatttaaaaacattaaaaatcattttaaaaaatttatttatagaacaattaaataaatatttcagctaataaaaaacaaaagcttacctagccttagaagacaacttgtccaacaattagatgatacccattgcccttacgttttctttaacatcaattattgtttttgtcaacaagctatcttttagttttattttattggtaaaaaatatgtcgccttcaagttgcatcatttaacacatctcgtcattagaaaaataaaactcttccctaaacgattagtagaaaaaatcattcgataataaataagaaagaaaaattagaaaaaaataacttcattttaaaaaaatcattaaggctatattttttaaatgactaattttatatagactgtaactaaaagtatacaatttattatgctatgtatcttaaagaattacttataaaaatctacggaagaatatcttacaaagtgaaaaacaaatgagaaagaatttagtgggatgattatgattttatttgaaaattgaaaaaataattattaaagactttagtggagtaagaaagctttcctattagtcttttcttatccataaaaaaaaaaaaaaaaatctagcgtgacagcttttccatagattttaataatgtaaaatactggtagcagccgaccgttcaggtaatggacactgtggtcctaacttgcaacgggtgcgggcccaatttaataacgccgtggtaacggataaagccaagcgtgaagcggtgaaggtacatctctgactccgtcaagattacgaaaccgtcaactacgaaggactccccgaaatatcatctgtgtcataaacaccaagtcacaccatacatgggcacgcgtcacaatatgattggagaacggttccaccgcatatgctataaaatgcccccacacccctcgaccctaatcgcacttcaattgcaatcaaattagttcattctctttgcgcagttccctacctctcctttcaaggttcgtagatttcttccgtttttttttcttcttctttattgtttgttctacatcagcatgatgttgatttgattgtgttttctatcgtttcatcgattataaattttcataatcagaagattcagcttttattaatgcaagaacgtccttaattgatgattttataaccgtaaattaggtctaattagagtttttttcataaagattttcagatccgtttacaacaagccttaattgttgattctgtagtcgtagattaaggtttttttcatgaactacttcagatccgttaaacaacagccttatttgttgatacttcagtcgtttttcaagaaattgttcagatccgttgataaaagccttattcgttgattctgtatggtatttcaagagatattgctcaggtcctttagcaactaccttatttgttgattctgtggccatagattaggattttttttcacgaaattgcttcttgaaattacgtgatggattttgattctgatttatcttgtgattgttgactctacagaatatgagccccgagagaaggccagctgacattcgccgtgcaactgaggctgatatgcctgctgtgtgtacaattgtcaaccactatatcgaaacttcaacagttaactttaggactgaaccacaagagccccaagagtggaccgacgatcttgtgagattgcgcgaaaggtacccttggcttgttgcagaagtggacggagaagtggcaggcatcgcctatgctggtccctggaaggccaggaatgcctacgattggactgcagagtctacagtttacgtgtccccacgtcatcagagaaccgggttaggctcaacattgtatacccacctcttgaaaagtctcgaagctcaaggtttcaaatccgtagttgctgtcattgggctccctaatgatccttctgttcgcatgcatgaggctcttggttacgccccaaggggaatgcttagagcagcaggctttaagcatggaaactggcatgatgttggattctggcagttggatttcagtttacctgttccaccaagaccagtactgcctgtgaccgaaatagtttaaaccgcgcctaggaaacttatctctgttatgaatcagaagaagttcatgtctcgtttcatttaaaactttggtggtttgtgttttggggccttgtaaagcccctgatgaataattgttcaactatgtttccgttcctgtgttatacctttctttctaatgagtaatgacatcaaacttcttctgtattgaaattatgtccttgtgagtctctttatcatcgtttcgtctttacattatatgtgctacttttgtctaatgagcctgaaaagtggctccaatggtacgcactggaagatttgttggcttctggtagatatagcgacagtgttgagcttgtaatatcatgtctcttattgctaaattagttcctttcttaacagaaaccttcaaagtttttgtttttgttttcatttacctaatgtacacatacgctggccatgactaacaacatgtccaggcttagagcatatttttttctagcttaaattgttaacttgtcattcagtaaaatccgagaattgtgaagctctaattgaagctaattcgttttataaagtcagttaaaaagtatactaaattatccaacttttcttcaaaatctcaaaattctatgacaaaacgatagtctttgtttatgtcagtaccacaaagaggtggaaaaaaacaccaaaaaaacaataagcaaactatacactgagaagaaaaataaaagagagctcaatagatgttttatactaacggtagattagatcaaagatccaagctttactctacatagagcagaacccagaatcccttcatatctcttttattctagcaccgataatctactgaaaagaagacacttagagctctgtctctttgtcaaagaagtcccagccgtcatccagaagctccttacgttcattaacagagggcaacttta

SEQ ID NO: 107 - DNA, 33909 bp, Artificial sequence
  Synthetic construct
ctaggaaatatcagccgcttgtgtgttcaattcttctctgtttcacttgaaacaaattgaatagatattcccgctttcaaagccatttacaaatcctctcgtgcagcctaacgccattggcgtggaacaagcgttggcacgaggaagtaagtgcgatgaacggaaggtattcaccgacgcggcaggattttaagacaggcgcgaagccttggtctatattagcccttatcgttgccgcaatgattttcgcgttcatggcggttgcgtcctggcaggacaatgggactacccaggcaatccttagccaaatacgatcgattaacgctgacagcgcctcactgcagcgcgatgtactccgcgctcacacgggcaccgtggcgaactaccgccccattatctccaggctgggagctctgcggaagaatctggaagatttgaagcaattatttaggcaatctcatattgtaagtgagagcaatgctgctcaactgctacgccggctagaagtgtctctaaattcggctgacgcggcggtcgccgcctttggtgcgcaaaatgtccgcctgcaagattcgctggccagtttcactcgtgctttaagcaatcttccaggaaaggcctcaggcgatcagactttagaaaaaccaacagaattggctagcatgatgctccaatttcttcggcaaccaagcccggctatttcattcgagatcagccttgaactagagaggctccaaaaacaacgcggtcttgatgaagctcccgtgcgcatactttcgcgtgaaggtcccattatcttatcgcttttgccacaggtgaacgatctggtgaacatgattcagacgtctgacaccgcagaaattgcggaaatgttgcagcgtgagtgtttggaggtctatagcttgaaaaatgtggaggagcggagcgcacgtatctttcttgggtccgcttcagtgggtctttgcctgtacatcatcaccttagtctataggctacgcaaaaaaaccgattggttagcgcggcgtttagattacgaagagctaatcaaagagatcggagtatgttttgaaggtgaggcggccactacgtcgtccgcgcaagctgcacttggtattattcagcgcttctttgatgccgatacgtgcgcgttagctctagtggaccatgaccgtaggtgggctgtcgaaacattcggtgcgaagcacccaaaacccgtgtgggacgacagggtgctacgcgaaatagtctctcgtaccaaagcgaacgaacgggcgacggtattccgcatcgtatcgacgcaaaaaatcgtacatttgcctcccgaaattccaggtctttcgatactactggctcacaaatccacagataaactaattgcggtttgttcactgggttaccaaagctatcgccctcgaccttgccaaggcgaaattcagcttcttgaactcgccaccgcctgcctctgtcactatatcgatgttcggcgtaagcagaccgaatgcgacgttttggccagacgattggagcatgcgcaacgccttgaggcagttggtacacttgccggcggaatagcacatgaatttaataacattttggggtcaatcctcgggcacgcagaattggcccaaaactcggtgtctcgaacatctgtcacccgaagatacattgactatatcatttcgtcaggcgacagagccatgctcattatcgatcagatcttgacgctgagccgaaaacaagagcgcgtgatcaagccatttagtgtctcagagcttgtgaccgaaatcgctcccttgctacgtatggctcttcccccaaccatcgagcttagtttcagatttgatcaaatgcagagcgtgatcgaaggaagcccgcttgaacttcaacaggtactaattaacctctgcaagaatgcttcccaagccatgactgcaaatggtcaaatcgacatcttcgtcggccaagcttatttaccagctaagaaaattctggcgcatggtgttatgccacctggcgactatgttctactatctgtcagcgacaatggtggaggcatttcagaggctgtgctaccctacatttttgaacccttctttacgacacgtgctcgcaacggtggaacgggtctcggcctcgcttctgtgcatggtcatatcagcgcgtttgcaggttacatcgacgttagttcaactgttgggcatgggacgcgctttgacatttatctccctccgtcttctaaggagcccgtcaatcccgacagctttttcggccgcaataaggcaccgcgtggaaacggggagattgtggcacttgttgagcccgatgacctcctgcgggaggcgtatgaagacaagatcgccgctctgggatatgagccggtcggttttcgtacctttagtgaaattcgcgattggatttcaaaaggcaatgaagccgatctggtcatggtcgaccaagcgtctcttcctgaagatcaaagtcctaattccgtggatttagtgctcaagaccgcctccatcatcattggcggaaatgatctcaaaatgcccctttcaagggagaatgcgaccagggacctttatctgccgaagccgatatcgtccagaactatggcgcatgcaatcctaaccaaaatcaagacgtagagttgcgacgtatcaggactgggcaatcgcggccgccgggcttacgtgtcttttgtaacaaattgcgacgcagttgatatccacttgaaacattagtccgaaattatcgagatctccgctgataaggtatcgaaatggcgataaaattggtattgatactcgtattcacactctttcccgcggcagacgctgcatatgcgaatgaccgcgccaacggtttcatgtggtcaaacgggggcgaaactggagtgaggcttcctcttcgggtgttcaatgccaagccagccaagaacacggtggcgatcatttattccggagacgctggatggcaaaatatcgatgaggcgattggtacctatctgcagacggaagggattcctgtcattggcgtcagttcacttcggtatttctggtcggagcggtccccaagcgaaactgctaaggatcttggtcacataatcgatgtctacaccaagcatttcggtgtgcagaatgttttacttgtaggatattctttcggcgcggacgtcatgccggcaagcttcaataggcttacgcttgagcaaaaaaatcgggttaagcaaatctctctcttggcattgtcacatcaagtcgactatgtcgtctcatttaggggctggctccaactcgaaacggaaggtaagggcggcaatcctctggatgatctcagatccattgaccctgcaatcgtccaatgcatgtacgggcgcgaagaccgtaataatgcttgcccatctctccgacagaccggcgcagaggtgataggcttcagcggaggccatcactttgataatgatttcaaaaaactgtctacgcgcgtcgtctcaggcctcgtggcacgcctaagtcatcagtaatctttagttcctgcaccgcgggacccgcgaggtttctcgcttcaattgaaatcataaagaagcaattgaaaattttcgagtaaccgaccctcccgataatcttcaacataaaacaacgcacttcttccaacgggagaggcggtgttagttgcgagctaaggagataaggtatgcttaagagatcggggtcgctttctcttgccttgatggtctccttctgttcgtcgagccttgccacgccactctcatctgctgagtttgaccatgttgctcgcaagtgtgccccatcagttgcgacatctacgcttgcggcgatagctaaggtggagagtcgctttgatcctttagcgattcatgacaacacgaccggcgaaacgcttcactggcaagatcacagccaagcaacccaagtcgtcaggcaccgtctcgatgcacggcattcgctggatgttggcctcatgcaaataaactctcgaaatttttctatgctcggtctgacacctgacggtgcgctccaggcgtgcacatcattatctgccgctgcaaacatgctgaaaagtcgttatgcaggcggcgaaacgattgacgagaagcaatttgcgcttcgtcgggcgatctccgcttacaacaccggtaatttcatcggcggttttgcaaacggctacgtgcgaaaagttgaaacagctgctcaatcgctggtgcccgcgttaatcgagcctccaaaagacgatcacgaggcgctaaaatccgaagagacgtgggatgtttgggggtcatatcagcgccgctcgcaggaggatggcgctggcggtttaatcgctccgccaccgccacaccaggacaacggcaaatccgcagacgacaatcaagtcttattcgacttatactaaggaggtgcgcattgatgcgatgctttgagagataccgtttacatctaaatcgcctctcgctctcgaatgcgatgatgcgcgtgatatcgagctgcgccccaagcttgtgcggtgcaattgcatggagcatttcctcatccggacccgccgcagcgcaatctgcgggtggcggcactgaccccgccacaatggttaacaatatatgcacgtttatccttggtccgttcggccagtcactcgctgttctcggcattgtcgctatcgggatctcctggatgttcgggcgggcttcgcttgggctggttgccggcgtcgtcggcggcattgttatcatgtttggggcgagcttcctcggccaaacgctcactggcggtagttgatggctgatcgtttggaagaatcgaccctttacctcgcagccacacggcccgcattgtttcttggggtgccactgacattggcagggttattcatgatgttcgccggctttgtcatcgttatcgttcagaacccgctctacgaagtcgttctcgtgccgttatggtttgcagcccggctcatcgtggagcgagactacaatgcggcgagcgtcgtcctgctatttttgcggaccgcgggaagaagcattgatagtgcagtttgggggggcgctactgttagcccaaatccaattagggttcccccacgagggagaggaatggtgtgatgctcggcgcgagtggaacgaccgaaagatccggtgagatctatctcccttatattggccacctcagcgaccatatcgtccttcttgaagacggatcgatcatgaccattgcgagaattgatggcgttgcattcgagcttgaggaaactgaaatgcgcaatgcgcgttgtcgtgcgttcaacacgctgttgcgcaatatcgctgatgatcatgtgtcaatatatgctcacctcgtacgtcatgccgacgtgccatcatcggcgccgcgacacttccgtagtgttttcgccgctagcctgaacgaagcttttgaacagcgcgtgctctccggccaactcctccgcaatgaacacttccttacgttgattgtctacccacaggcggctttagggaaggtaaagaggaggttcaccaagctaagcggaaaaagggaaaacgatctcacgggccagatcaggaacatggaagatctttggcatgttgtcgctggctctcttaaagcgtatggcctgcatcgtcttggcatccgcgagaagcagggtgtgctcttcaccgaaattggcgaagcgctacggttgatcatgactggtcggttcacaccggttccggtcgtcagcggctcactcggcgcttcgatttataccgacagagtcatttgcggcaagcgaggactcgagatcagaacgccaaaagacagttacgttggatccatctattcgtttcgcgaataccctgcaaaaacacggccgggcatgctcaacgcgctgctatccctcgattttccacttgttctcacgcagagtttttcgttcctgactcgcccgcaagcgcacgcgaaacttagcctcaaatcgagccagatgctgagttccggcgataaagccgtgactcaaatcggcaaattatccgaggctgaggacgcacttgcgagcaacgaattcgttatgggctcacatcatttgagcctttgcgtctatgcagacgatctcaatagtcttggggacaggggcgcgcgggctcggacacgaatggcggatgcaggtgccgtggttgtccaagaaggtattggtatggaagcggcctattggtcccaattgccggggaattttaagtggcgcacacgccctggcgcaatcacttcacgcaatttcgcagggtttgtctctttcgaaaactttccagagggcgccagctcaggccactggggcaacgcgattgcccgatttcgtaccaatggcggaacgcctttcgactatatcccgcatgagcacgatgttggcatgacggcaatattcgggcctatcgggaggggtaagacgacgctcatgatgtttgttctagccatgctcgaacagagcatggtcgaccgtgcaggtacggtcgtgttctttgacaaggaccggggtggcgaattgctggttcgcgccacaggaggaacatatttggcacttcacagaggcacacccagcgggttggcgccgttgcgtggcctagaaaacacagcagcctcacacgattttctgcgcgaatggatcgtggctctcatcgagagtgatggtcggggtgggatttctccggaagagaaccgccgtctggtccgtggtatccatcgtcagctctcgtttgatccacaaatgcgttcaatcgcggggttacgtgaatttttgttgcatgggcccgccgaaggcgcaggagcgcggctccaacgctggtgccggggccatgcgcttggctgggcatttgacggcgaagttgacgaagtaaagttagatccgtcgattaccggcttcgacatgacgcatcttctcgaatacgaggaagtatgcgctcccgctgcagcatatctcctgcatcggattggagccatgatcgacggccgccgttttgtgatgagctgcgatgagtttcgcgcctatttgttaaaccctaaattttcgactgtcgtcgacaaattcctcctgaccgttcgaaaaaacaacgggatgctaatactggcaacgcagcaaccagagcatgttctggaatcgccgctaggagccagcttggttgcgcaatgtatgacgaagattttctatccatcaccaaccgcagatcgatcggcttatgtcgatggactgaaatgtaccgaaaaggaatttcaggcgatccgtgaagacatgacggtcggcagccgtaagtttcttcttaaacgagaaagtggaagcgtcatctgcgaatttgatctgcgggatatgcgtgaatatgtcgccgtgctttcggggcgtgccaacacggtgcgctttgcaactcgactacgcgaggcacaagaaggcaactcatctggctggctcagcgaattcatggcccgtcaccacgaggcagaagattgataaggtaggaaacgatgaagacgacgcaacttattgcaacagttttgacctgcagctttctatatattcagcccgcgcgggcgcagtttgttgttagcgacccggcaacggaggctgagacgctcgcgactgcgctcgcgactgcggagaatctcactcagactatagcgatggttacgatgttgacgtcggcctacggcgttactggactactgacttcgctcaaccagaaaaatcagtatccttcgacgaaggacctagacaatgaaatgttttcgccgcgaatgccaatgtcgaccacggcacgtgcgatcaccagcgatacagatcgtgcagtcgtgggtagtgatgctgaagcggacctgttgcgatcgcagatcaccggttccgcaaacagcgctggcattgcggctgacaatctggaaacgatggacaaacgcttgacggcgaatgctgatacgtctgctcagctttcccgatctcgcaatatcatgcaggcaaccgtgaccaatggtttgcttctcaagcagatccatgacgcaatgattcaaaatgtacaggcgacaagcctattaacgatgactaccgcgcaggccggccttcacgaggcggaagaggcggccgctcaacgcaaggagcatcaaaagaccgctgtcatctttggtgccctcccctaaggctgggcgatttgttcatccgcccgcatcctcgccgaatgcgagctcattttatccaacattatgcgacaaaccagtcaagttcaggtccaatcgatgaatttcacgattccggcgccgtttacggccattcatacgatcttcgatgtagccttcacgacaggcttggactcgatgcttgagactatccaggaggcggtgagtgcgccattgatcgcctgtgtcactctttggattattgttcagggtattttagtcatacgcggcgaagtcgatacccgtagcggtatcactcgggtgatcacggtcaccatcgttgttgctctaattgttgggcaggctaactaccaagactatgtggtttccatcttcgaaaagacggtcccaaactttgttcagcagtttagtgtaaccggcttgcctctgcagactgttccggcacagttggatacaatgttcgccgtgacccaggccgtttttcagaaaatcgcatccgaaatcggtccgatgaacgaccaggacatccttgctttccaaggggcacagtgggtcctttacggcacgctctggtctgccttcggagtttacgacgccgttggaattctcacgaaagtgcttctcgcgatcgggcctctgatcctcgtcggatatatttttgatcgcacgcgggacatcgcagctaagtggatcgggcaacttatcacctacggtctcttgcttctcctcttaaacctcgtggcaacgatcgtcatcctaaccgaagcgactgcgctcacccttatgcttggtgtaatcaccttcgccggtacgaccgcggccaagatcattggtctttacgaactcgatatgttttttctgacaggggatgcgctcattgtcgctttgccggcgatcgccggcaacattggaggcagttactggagcggcgcaacccaatctgccagcagcttgtaccgtcgcttcgctcaggttgagcgaggctaggtcgcgcaaaaattcgcctcaatggagaattctatgaagtattgcctgctgtgcctagttgtcgctttgagcggctgccagacaaacgacacattagcgagctgcaaaggcccgatcttcccgctgaatgtggggcgatggcagcctactccgtcagatcttcagctcggcaattcgggtggacgctatgacggggcctgaatatgccatgctagtggcgcgcgaaagccttgccgagcactataaggaagtagaagcctttcaaaccgcgcgagcgaaatcggcgcgacgtctctccaaactcattgcagctgtcgcagctatcgcgattttgggaaatgttgctcaagcgttcgctatagccacaatggtgccgttgagcaggcttgtgcccgtatatctatggatacggccggacggcaccgttgacagcgaggtgtctgtctcgcgattgcctgcaactcaagaggaggccgtcgttaacgcctcattgtgggagtacgttcgcctgcgcgagagttatgatgccgacaccgctcagtacgcctacgacctggtatcgaacttcagtgccccaacagtgcgccaggattaccagcaattcttcaactatcccaatcccagttcgcctcaagtcattcttggcaaacgcggcagggtggaggtcgagcacatcgcttcaaatgatgtaactccaagcacgcagcaaattcgctataaaaggaccctcgtcgttgacggcaaaatgcctgtggtgagtacgtggaccgcgacagttcgctacgaaaaggtgaccagcttgcccggcagattgagactaaccaacccggcaggtctggttgtcacctcctatcagacatcggaagataccgtttcaaacgtaggccacagcgaaccatgatcagaaaagcacttttcattttagcatgtttatttgccgctgcgactggtgcggaggctgaagacactccaatggcgggcaagctagatccgcgcatgcgttatttggcttacaatcccgatcaagtggtgcgcctctcgacggcggttggagctactttggtcgtaacattcgccacgaacgaaacggtgacagcggttgccgtttcaaatagcaaagatctagcagccctaccgcggggaaattatctatttttcaaggcaagccaggtcctcacgcctcagccagtaatcgtgctaaccgcaagcgactccgggatgcgccgttatgttttcagtataagttccaagactctgtcccacctcgataaagagcagcccgatctctattacagcgtccaattcgcctaccccgccgacgatgcggcggctcggcgaagggaggcacaacagaaggctgttgtggacagactacacgcggaagcacaatatcaacggaaagctgagaatttattggatcagcctgtcacagcccttggtgcggcggacagtaattggcactacgtcgcccaaggcgatcgttcgctgttgccactcgaagtcttcgacaatggatttacgacggtattccactttccgggcaatgtacgcataccctccatctacaccatcaatcctgatggcaaggaagctgttgccaactattcagttaaagggagcgatgtcgagatttcttcggtttcccgaggttggcgtctgagggatggccacacagtactatgtatctggaacaccgcttacgatcccgttggccaaaggccgcaaacgggcacggtgaggcccgatgtgaaacgcgtcctgaagggggcgaagggatgaataacgatagtcagcaagcggcacatgaggttgatgcatctggatccctggtctccgacaaacatcgccggcgtctttcggggtctcagaaattgatcgtcggaggtgtcgttctcgcgttatcattaagcctcatttggctaggtgggcgccaaaagaaggtgaatgagaacgcatcgccgtcaactttgatcgcaacaaacaccaagccatttcatccagctccgattgaggtgccgccggatcctccagcggttcaagaggctgttcagcctgctgctcctctaccgccgaggggcgaaccggagcggcatgagccacggccggaagaaacaccgatttttgcatatagcagcggcgatcaaggggtcagcaaacgcgccattcagggcgacacgggccgaagacaagaaggcaagcgtgacgacaactccttgccgaatggcgaagtgtccggcgagaacgatttgtcgatacgtatgaaacccaccgagctgcagcccagcagcgccacgctcttgccgcaccccgattttatggtaacgcaagggacaataattccgtgcatcttgcaaaccgcaatcgacacaaatttggcaggctatgtaaagtgtgtcttgcctcaggatattcgtggaacaacgaacaatatcgtgcttcttgatcgtggcaccaccgttgttggcgaaatacagcgtggcttgcaacagggagatgggcgcgtttttgtgttgtgggatcgcgccgagacacctgaccatgcgatgatctcgttaacatcgccaagcgcggacgaactcggtcgctcaggattgccgggctcggtcgacagccacttctggcagcgttttagcggagctatgctcttgagtgttgttcaaggcgccttccaggcagctagcacctacgccggcagctcgggtggcgggatgagcttcaacagctttcaaaataacggtgagcagacaactgagacagcccttaaggcaaccatcaacataccgccaaccctgaagaagaatcagggtgacaccgtttccattttcgtagcacgggacctcgatttctttggtgtttaccagctccgcctgactggcggcgccacgcgggggaggaaccgccgctcttaatgaattcaaatttccgcttagagataggatacattgtaaatggaagtggatccgcaactacgctttcttctgaagccgattttggaatggctcgatgacccgaagactgaagaaattgcgatcaatcgacctggagaggcatttgtgcgccaagccggcatttttaccaagatgcctttgcccgtctcttatgatgatcttgaagatatcgctattttagcgggcgcgctgagaaagcaggatgtcggaccacgtaaccccctctgcgccactgaacttcctggtggtgaacgactacaaatctgtctgccgccgaccgttccctcgggcaccgtcagcttgaccattcgacggccaagctcgcgtgtttctggtcttaaagaagtctcctcccgttatgatgcttcgaggtggaaccagtggcagacacgaaggaaacgccaaaatcaggatgatgaagctatccttcagcattttgacaacggggatttggaagcgtttctgcacgcatgcgtcgtcagccgactgacgatgttgctatgtggccctaccggaagcggcaagacaacaatgagcaagaccttgatcagcgccatccccccccaggaaaggctaatcaccatagaagatacgctcgaactcgtcattccacacgataatcatgttagactactctactccaagaacggtgctgggctgggtgctgtgagcgccgagcacttgctccaagcaagtctgcgtatgcggccggaccggatattgcttggcgagatgcgcgacgatgcagcatgggcttatctgagtgaagtcgtctcgggacatccgggatcgatttcaacaatacacggcgcgaatccaatccaaggattcaagaaactgttttcccttgtcaaaagtagcgcccaaggtgctagcttggaagatcgcacactgattgacatgctctctacggcgatcgatgtcatcattccattccgtgcctatgaggacgtttatgaagtaggcgagatctggctcgcggcggacgcacgacgccggggcgagaccataggcgatctccttaatcaatagtagctgtaacctcgaagcgtttcacttgtaacaacgattgagaacttttgtcataaaattgaaatacttggttcgcattttcgtcatccgcggtcagccgcaattctgacgaactgcccatttagctggagatgattgtacatccttcacgtgaaaatttctcaagcgctgtgaacaagggttcagattttagattgagaggtgagccgttgaaacacgttcttcttatcgatgacgatgtcgctatgcggcatcttattatcgaataccttacgatccacgccttcaaagtgaccgcggtagccgacagcacccagttcactagagtactctcttccgcgacggtcgatgtcgtggttgttgatctaaatttaggtcgtgaagatgggcttgagatcgttcgaaatctggcggcaaagtctgatattccaatcataattatcagtggcgaccgccttgaggagacggataaagttgttgcactcgagctaggagcaagtgattttatcgctaagccgtttagtacgagagagtttcttgcacgcattcgggttgccttgcgcgtgcgccccaacgttgtccgctccaaagaccgacggtctttttgttttactgactggacacttaatctcaggcaacgtcgcttgatgtccgaagctggcggtgaggtgaaacttacggcaggtgagttcaatcttctcctcgcgtttttagagaaaccccgcgacgttctatcgcgcgagcaacttctcattgccagtcgagtacgcgacgaggaggtttacgacaggagtatagatgttctcattttgcggctgcgccgcaaacttgaggcggatccgtcaagccctcaactgataaaaacagcaagaggtgccggttatttctttgacgcggacgtgcaggtttcgcacggggggacgatggcagcctgagccaattgcatttgattaatttaggtgactgaggacgcggccagcggcctcaaacctacactcaatatttggtgaggggttccgataggtccctcttcaccaattgctcgatggcttctctccagcaaagaatgacgcgagcgcggcggtagccagcttgtggccgaaagctcgagcggtctccaaccccaacggatcaaaatgacttcgagcgacctcgagcaacgcaaccgggaacatgcgtgaggtctgaacgagaacggatttttctgtagttgaagggatcggataacttttcggggccacgcgaaatgatccatctgccagcatgctttcgaaatcgtccaacgcgcgccttaaaatcatttgtagcgacttcgagggactgtattgccgaacgaggttgtcatatgttttcgacacttgaggcgcgggcggtcgcgctgaaagaaaaacctggagctttttcggggacggaggtggactaagggcatccacagttagcttaagttgtcgatcgggactgtaaatgtgatcggcgacgagaggctcacgttgctggtctttctcgtcggctttttcaggcaagtgctggaggtccagcttctggggaacaagtgtcgggttgggatggtggatctcgggtcgagcaccagcaagccgccgtgcttcgccgaccgacaatgcgggcttgcgaattgccatcttcaagcctccaagattttgctgatcagtttcgaaatgaccacgacttcctccatcgcaatccgaagattcctctctatgaggcgcatcgtcggatcagttcccgtgtttagtaatgtaagatgcaacatgccgcgttctttcatcgcggcaaatgcatctctttcatgcatgggagacggtacaactggaaggctctctagcgtctctgacatcctgcgttgcgatgttgtcaatcggccgaccgggacgcgttggcgcaaaacagctgtaggaattgccaaattttcactcaacagcagctcgatgacgtagcggtaggtagatagtgcctcatcgatgtcgagcggcgttagcatggtggggatcagaagcaggtttgagctagcgatgattgtgttgttgagctcgctcgagccgccacgcgtatcggccaacgcataatcaaatccttcgagctcggcattttcataggctgcttcaagaaggggcatttcgtcggcggaatagacttcacagcgaggatcccaggtactgctttgtaaggcgttttctctccatcgcgtcagaggccggttttcgtcggcatcaaagagggccactcgtttaccgtcatttgccaaagcagcgcaaaggcccatgagtgcggtggttttgccagcaccccctttgaaagaacaaaacgtcaaaagttgcatattctgatcccgcctatcctgtgaaaccggagtgcatttgtatttttgttcgtataaatgtttttgtgattatcgatgagtaaaagcgttgttacactatttttatttcacattcgttataagacaattgcaaatgtagcaagtatattcagtattgactgtaaatgtactgttgatttcatattgagcagggctagacttccatccgtctacccgggcacatttcgtgctggagtatccagaccttccgctttctttggaggaagctatgtcaaaacacaccagagccacgtcgagtgagactaccatcaaccagcatcgatccctgaaagttgaagggttcaaggtcgtgagtgcccgtctgcgatcggccgagtatgaaaccttttcctatcaagcgcgcctgctgggactttcggatagtatggcaattcgcgttgcggtgcgccgcatcgggggctttctcgaaatagatgcagacacacgagaaaagatggaagccatacttcagtccatcggaatactctcaagcaatgtatccatgcttctatctgcctacgccgaagaccctcgatcggatctggaggctgtgcgagatgaacgtattgcttttggcgaggctttcgccgccctcgatggactactgcgctccattttgtccgtatcccggcgacggatcgacggtcgctcgttactgaaaggtgccttgtagcacttgaccacgcacctgacgggagaaaattggatgcccgatcgcgctcaagtaatcattcgcattgtgccaggaggtggaaccaagacccttcagcagataatcaatcagctggagtacctgtcccgaaagggaaagctggaactgcagcgttcagcccggcatctcgatattcccgttccgccggatcaaatccgtgagcttgcccaaagctgggttacggaggccgggatttatgacgaaagtcagtcagacgatgacaggcaacaagacttaacaacacacattattgtaagcttccccgcaggtaccgaccaaaccgcagcttatgaagcaagccgggaatgggcagccgagatgtttgggtcaggatacgggggtggccgctataactatctgacagcctaccacgtcgaccgcgatcatccacatttacatgtcgtggtcaatcgtcgggaacttctggggcaggggtggctgaaaatatccaggcgccatccccagctgaattatgacggcttacggaaaaagatggcagagatttcacttcgtcacggcatagtcctggatgcgacttcgcgagcagaaaggggaatagcagagcgaccaatcacatatgctgaatatcgacgccttgagcggatgcaggctcaaaagattcaattcgaagatacagattttgatgagacctcgcctgaggaagatcgtcgggacctcagtcaatcgttcgatccatttcgatcggacgcatctgccggcgaaccggaccgtgcaacccgacatgacaaacaaccgcttgaaccgcacgcccgtttccaggagcccgccggctccagcatcaaagccgacgcacggatccgcgtaccattggagagcgagcggggtgcccaaccatccgcgtccaaaatccctgtaactgggcatttcgggattgagacttcgtatgtcgctgaagccagcgtgcccaaacaaagcggcaattccgatacttctcgcccggtgactgacgttgccatgcacacagtcgagcgccagcagcgatcaaaacgacgtcatgacgaggaggcaggtccgagcggagcaaaccgtaaaagattgaaggccgcgcaagttgattccgaggcaaatgtcggtgagcccgacggtcgcgatgacagcaacaaggcggctgatccggtgtctgcttccatccgtaccgagcaaccggaagcttctccaacgtgtccgcgtgaccgtcacgatggagaattgggagaacgcaaacgtgcaagaggtaatcgtcgcgacgatgggcgcggggggacctagactagtagacaggaaggaccgaataatggcaaatggtcagttcacgatacgctctgctcgcccggcctccgtcggactgacaggcgaacggcgtggagccgcatccgcctctagctctgcactgtccaatgttcaaagagatgttagggataggctgattccaactagctcaccaagattaccaaatgcagccatattgcgtgattcctcgggaagagcgtcgactggtctgcggtacatggcggctactcttcattggtctgcgatcgcgccattatcgctaataaacagcaacgacctggctccggccgcttatgactttgagacgcgaaataacgcaagaaatgtgactgccaaagtcggcagggcagtccctgttcccaagcaaggcgggctcggcaaaacgctcgcacccgtaccccttagtacacgtatatcaagggtcaattccgaccgaagactgcccgctgacgcagaagaccgccctgaaacgcgcgacccccagaaaggacgtggcagtcatggtgcgacgccaaccttacatgaaaagattggaaccgcgtttgctcgaagattgcgaaagcatacgtactatattgtttgcagttgctgccagacccggagcgcgttgacgatgggtgcaaagatttcggtgaagtcatgaactccagcaagacttcgccccagcgtatgaccctgagcatcgtatgttcgctggcagccggtttttgtgcggccagctgctatgtaacgttccgccggggcttcaacggcgaagcgatgatgacgttcgacgttttcgctttttggtatgagaccccgctttacttgggttatgccagcaccgtcttctggcgtggtttatctgttgtcatctttacctcgctgatcgttctttcaagtcagctcatcatatcgctgcgcaatcagaagcatcatgggacagctcgttgggcagaaattggcgaaatgcggcatgctggttatctgcagcgttacagtcgcatcaaggggccgatctttggaaagacatgtggtcccctttggttcggcagttatttgaccaatggcgaacagccacacagtcttgtcgtcgcgccaacgcgtgctggcaaaggcgtcggcatcgtcattccaacgctgttgaccttcaagggctcggtaatcgcccttgacgtcaagggagaattgtttgaactgacgtccagagcacgcaaagcgagcggcgacgcagttttcaagttctcccccctagatcctgagcggaagactcattgttacaatccggtcctggatattgccgcacttccgcccgaacgccagttcactgaaacacgccgtctagctgcgaaccttattacggctaagggaaagggagcagaaggctttattgacggcgcacgtgacctgttcgtcgcgggaatccttacctgcattgagcgtggcacaccaacgattggcgcggtatatgacctatttgcgcagcctggcgaaaagtataagctttttgcgcaactcgcggaggaaagcctaaacaaagaggctcagcgtatcttcgataatatggcgggcaacgacacgaaaattctgacatcgtacacctctgtgctgggcgacggtggactgaacctgtgggctgatccgcttatcaaagcagcgacaagccggtcagacttttccgtttacgatctccggaggaagaagacctgcatttatctttgtgtcagtcccaacgatctggaggtcttggcaccacttatgcgcctgatgtttcagcagctcgtgtcaatcttgcagagatcgctgccaggtgaagacgagtgccatgaagttttatttctcctcgacgaattcaaacacctgggcaagcttgaggccatagagaccgcgatcacaaccatcgccggttacagaggccgctttatgtttattattcaaagtctttcggccttgtcgggcacatacgatgacgcaggaaaacaaaactttctgagcaatactggcgtacaagtatttatggccacggctgatgacgaaactccaacctacatctcaaaagctatcggcgaatatacgtttaaagcgcgttcgacctcttacagtcaagccagaatgttcgaccacaacatccagatttctgatcaaggtgcagcccttttgcgccccgaacaagtgcgcctgctagacgatcagagtgaaatcgttctcatcaaagggcgacctccactcaaattacgaaaggtgcagtattattccgatcgtacgctgaaaggccttttcgaacgccagatgggctctctgcctgagcccgcacccttgatgctttccgactatagcaacgatcaagttcaataccacttggctccgatagcaaattttaatgaggatgctgcaccgcaaaacagaactgtggccgaggaccatggaagtgttaaagtcggtgctgatatccctgaacgcgtgatgggaataaatggtgacgaggaacaagccgatgcgggcgagataccgccggaatcggttgtgcctccagaattgacgctcgctctgaccgctcaacagcaattgttggaccagattattgcacttcagcaaagatcgaggtccgcaccggcatagcctgcgaaatgatcttaatggtgcaattcgtttcaggcggcatgttgcggttcaacaaagtgtacgccagatcccaattggccctttacgaggtgtcggtatgacaggaaagtcgaaagttcacataagaggttcggctgacgcgcttcctgacgttcctggcggaagtactaccgccccttttttaaccgaaccttctcgggatcaggttgatgcctcgtttgaggtccaaaccgactacagccagtctacttccgtgtcgtttacctatgatggtgttggacttggtcctgccgagcgtgcggcttacgagaactggtgcgaaccgggccggcccacttggaaagatcttataatcaaggcacgtgtcgatccgattgacgatgtgacctggctccgagatttagaagaggacaccccctcaaccttcagatacgaagggatgcctctgggcatcggggaacgacaggcctacgaaaattggcaagaggacgctcagccgacatgggaagaccttgttgtcagcgcacgcttgacggaacttggccgtccacacgggattaccggcgagtatacatccctcgcaggatcgaagaatacaagttcaatttcattgaagcgaaagcggagcaacttaattgatgatgagaattcatccggatcgttttcatatgacgggatgaagctcggggaagccgagcgttctgcatatggtgactgggccgaggcggagccacccacgtggaaagatttggtattgagggcacgcgtttcctcgatcaatgactctgcttggctttttgattcacaaacatcttcatcatcatttgaatacaacggtgttcccttgggcgagccggaacggcaggctctcagacaatggcaaggagacgctcagcctacctgggaagatctcgttgttaacgcgcgtatggcagaactttgccatgctggttggattgaaggtcaaaaaggttgctttgaagagcgcggggaggctctgcccgcgtcggaacgcggttcgcaacgccccattggtcaacggacagattcctccgattcttttgtgtatgatggcacaaggctcggagcacctgagcgaactgcttatgaacgctggagtaagagggaacgcccgacttgggaagatctcatcttagatgcacaccaggccaggactgaaagtgacgctgttacgacccaagcgattggtcagtcgtcctcaccggttttcttatatgaaggaaagtcgctcggagacagggaacgaaaggcttacgaaaaatggcggcagccagcccaaccgcgatggcaaaatcttgtagtgaacgctcgtctggcagaaatcgatccctcagcctggattgccgatgagcgcgatccgcttgatgatagcgacgcgcttggtcgcccgtcgtacacaagcttgacggatagatcagacgtccctttagacgatcaatcaatctatcgtcgttccgacctagtaagggagcaggtgccagaatcgtctcaaaggcaattcgcagcatgttcagaatctgaaacgaggcctgtgcaatggtttactgcttctgggtcagatgcaaacaatacggaaaatatcaccgccagcgatcccgtcgatcgcacgggtggagttaagcggctaggctccaaaagcgacagaaccgttacagcttctatccatgacgtgaattccagcacaaggcgactgttgcttaacgaatttggatcggaggctccgcgcccttcgccagaaaagactgttcgcttaagaagcgacaatattggcacctatgggagccggaaaaatgaacgagcgcggctcgcgaccgaaaccggtgcgtatgagtcggagcatattttcgggttcaaggctgtccacgatactgcgagagcgacgaaagagggccggcgtctcgaaaggcccatgcccgcctaccttgaggataaggggcttcatcgccaacatattggcaccgggagaggacggaccaaacttgtcgggcgcggatggccggatgacacaagctatcgctcggatcaaagggcaactctgtcggaccccgttgcgcgctcggaaggcgcgacggcctcaaatgggtatcaattgaaccaattgggttacgcgcaccaactcgctagcgatggcctgcaaagtgaatcgcccgatggtgttgccttgccaattcaagtggcaacaacgagctacaactatacagtgagccgcgatcctgtccttgttccgccggataaaaacgaagcccctcaattgctgcatcttggtccccgtggtcaaaccgaagctgttcttgcccgcgaaacagcattgactggaaaatggccgactctcgagcgtgagcagcaagtgtatcgcgagtttttggccttatatgacgtaaaaaaagatcttgaggccaaatcagtcggcgtaagacggaaaaaaaaagaagttatttctgcgttagaccgaactgcgcgcttgataagcacgtcgccttcgaaagctcgatccaaagcagagactgaaaaagccattgatgagctcgatgatcgacgagtttatgatccgcgtgatcgagctcaagacaaagcgtttaaacgctgataagtcgccaatatagtgatcatttgcagtattcgcatcgatcgctggttgatattctgccgctggtcgaccggctgctcgtcgccaaaaatgctcacagggatacgatggcctcggtcaggccgcgtgcgtcctgtctttccagttcctccctttcagctcgattgtggcatcatttattgcctgctcattgcagttgaaacgcgatatccgtttcaagacccgggtatggatggtactttggagatatgagcacttgccagacttcccggtcggagacttaaaaattccgataagaggttacggacgacggaccttataagtggatcgtctagtggtggcgccgatcaaaacagttccgcccccggctttgctcaaagtagcaaagcagctttatctcgggttgcggaggattttctagaaaaccgcaattttgcaggagagaacatatggccatcatcaagccgcatgtgaacaaaaataggacaacctcgccgatagagagaccggagtctctcatagaggaaatgagcggcagtcatccgccgagtggttttaccaacctggatctcgctatgatcgagctggaggactttgtccatcggtgcccgctcccagaagacaatcttgctggtcagaaggagtgagacgatggatccgtctagcaatgagaatgtctatgtgggtcgcggtcacaacatcgaaaatgatgatgacactgaccccaggcgttggaagaaggcgaatatcagttccaacaccatctccgatattcagatgacgaatggcgaagacgtacaatcagggagccctacccgaacggaagttgtaagcccacgtctggattatggatcggtcgactcctcctccagcctttattctggcagcgagcacggaaatcaagctgagattcaaaaagagctgtccgtcttgttctcgaacatgtctttgccaggcaacgatcggcgcccggacgaatacattctcgtgcatcaaacgggacaagatgcttttactggtattgccaaaggcaacctcgaccaaatgcccaccaaggcggaatttaacgcgtgctgccgtctctacagggacggagccggtaattactacccgccacctctcgcattcgacaagattagcgttccagagcaactggaggaaaaatgggggatgatggaggcgaaggaacgtaacaaactgcggtttcagtacaagttggacgtatggaatcatgcgcacgctgatatggggatcacgggcacagagatcttttatcaaacagataagaacataaagctcgaccggaattataaactaagacctgaagaccgatacgtacaaacagaaaaatacgggcgccgggaaattcaaaagcgatatcaacacgaactccaggctggttcgctgctgcccgatattatgatcaaaactccccaaaatgacatccacttcgtgtacaggtttgccggcgacaattacgccaacaaacagttcagcgagtttgaacacaccgtcaagcgcaggtatggcgacgagactgagatcaaattgaagtcaaagtcaggcattatgcatgactcgaaatatctggaatcctgggaacggggcagtgcggatattcgcttcgcggaattcgttggggaaaatagagctcacaatcggcagtttccaactgcgacagtaaatatgggacagcagccagacgggcagggcggtttgacccgcgaccgtcatgtgagcgttgacttcctaatgcaaagcgcacccaattcgccttgggcgcaagctttgaaaaagggagaactgtgggatcgcgttcagttgcttgctcgcgacggcaaccgctatctgtcgccgcccagattggaatattctgaccctgcacatttcaccgagttgatgaaccgggttggtttacccgcatcgatgggtcggcaaagccatgcggctagtatcaaattcgaaaagtttgacgcgcaggcagcggttattgtcttaaatggcccagagttacgtgacattcatgacttgtctcctgaaaaactgcaaaatttgtccaccaaagatgtcatcgtcgccgatcgcaatgagaatggtcagagaactggcacgtacaccagcgtcgcggaatatgagcgcttgcagttaaggctgccacccgatgcagcgggggtgcttggtgaagcaactgacaaatattcacgtgatttcgttcggccagagccggcgtcgcgtccaatcagtgacagccgcaggatatacgaaagtcgaccgcgtagccaaagcgtcaacagcttttgacgttcctgctgccgcgtcaacgaggaagctcgtttgacccgggtttgccaatgaaagggctcaatcatggtgaacactacaaagaaaagttttgcgaagtcgcttacggcagatatgcgccgttctgctcagcgcgttgtcgagcaaatgcgaaaagcattgattaccgaagaagaggcgctcaagcggcaagccagactggagagtcccgataggaagcgaaagtatgctgctgatatggcgatagtcgacaaactcgacgtagggtttcgaggcgaaataggctataaaattcttggaaataaccggcttcgagtagacaaccataaagaattaacgcgtgagcacggtagacttcgcaaaaccaaaacggttctgaagcgtaacccggtgacgcaggaagtctatttgggtttatatgaaaggaagtcctggttaagtgtcagcagccatttgtatgctgcggacggcacactccgcatgaagcacgtgaaatacaaagacggacgttttgaggaaaaatgggagcgcgacgaaaatggcgacctgatccgcacaaggtacgccaaccgtggcaggctctttcaacctgtatccgagaaaatgggcgcgccgtatcggagcggccctgacgaccggctctatcgcgatctaacccgtcgaaacggtttcagacgggagacattcgaacgggacgatcacggaaacctcgagcgtatcggcagcaaccatgtcggcttttccaagatttcagtgaaggcacccaatcgtcaaacctcccagacgaagattcaaaaacttggtggcgctttcaacaaatcttttaggtcccttctggacaaggagggcaatgaaatgggccgcgatattttgagccatcgacggctctataacaagcggtctgctgtctacgatgaagctaccggacaattgaagagtgccaagcataccttcggcaagatctacaggagcgaaaccgaatatctcagcgcgggcctcaagaaggtttcaaaaaagatactcggggtgacggtctaccggaaatttgcggcgctcagcgagcgagaatccgaggctgagagactgcgtagttttgaatccggtgcgcatcgccagatctggcaggagcgggcagcgattcccggttcgcccctcccggagactgatgacattcatttcgcacagcagtcgcacctagccaaagccaaccctgatcacgtcgaagctgacgtcacgcgtgtgacagatcaacatgttgatgttgctggacaaacatcatcgtctccccaacggaacttggaaggatggttagattctcaatcacgatacaagccagcaaacatgctgttgtcaaatccagaccttcaagcgaacggacctcgcccatacgaagggttagctcatctcaccctccggcgcgataatgaatctgacgggcacaaggagaatgatcagcggctgcgacatttctcccagccagagccgttggtgttaccgcatcccgggtcgccggaaataactaaggtgtttggctcgcggggagagccggcacacccgagtggaaatctgcacacggcggttggagaaacggcttgcgaaggaccggtgatgtcttcatcctcggacaatcatcagccagctccaggacagcaagaacttttaagtttccttcataatgcgccagccccagtttctgtggcaatacatgatgatcaagagcgacttgcgggggaggcgcccggcggctctttcagaggtagctcagggcgaacgagttcaatgtcggagagtatcttcgacgaagatgtacaagggcatttggtacgggattattcgatcaatactactaacgggtttattgacccgcaatcgttgttcggtgaaccggacttatcgagaggtccaaaatcggggccagaaattccatcggaagattaccatttgtcagcttcggaacaggaaaatttgctgaatcaattgcttagtgtgccactgccggttccttcaccgaagcccgaatgcgcgaggtctatgattttcgaaggttcacgttcaagagagcgttccacctccagagggttctaaggtggaacgcgtctaggcttgcctatcatcaccacctcatgatggtcgcggagaccttcgaagagatatccgacatcattggagaagctgggccggaaactagtgtacctcgcgaatgcatctagatccaatccaatatgcatggcatgccgaatccatgtgggagtttattcttgacacagatatttatgatataataactgagtaagcttaacataaggaggaaaaacatatgttacgcagcagcaacgatgttacgcagcagggcagtcgccctaaaacaaagttaggtggctcaagtatgggcatcattcgcacatgtaggctcggccctgaccaagtcaaatccatgcgggctgctcttgatcttttcggtcgtgagttcggagacgtagccacctactcccaacatcagccggactccgattacctcgggaacttgctccgtagtaagacattcatcgcgcttgctgccttcgaccaagaagcggttgttggcgctctcgcggcttacgttctgcccaagtttgagcagccgcgtagtgagatctatatctatgatctcgcagtctccggcgagcaccggaggcagggcattgccaccgcgctcatcaatctcctcaagcatgaggccaacgcgcttggtgcttatgtgatctacgtgcaagcagattacggtgacgatcccgcagtggctctctatacaaagttgggcatacgggaagaagtgatgcactttgatatcgacccaagtaccgccacctaataatgtctaacaattcgttcaagccgacgccgcttcgcggcgcggcttaactcaagcgttagatgcactatacgtaccaatccaaatcggatccccctgcagggctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagcagatctatcgatggtacctatctgcagacggaagggattcctgttaattaagggcccaggtagaatccgcctgagtcgcaagggtgacttcgcctatattggacgacggcgcgcagagggcgacctctttttgggttacgattgtaggattatcactaaaacaatacatgaacatattcaaatggcaatctctctaaggcattggaaataaatacaaataacagttgggtggagtttttcgacctgtgggcgttaaccttctgttaacctaaaagctcttgcccaaacagcagaatcggcgctaattgccagcggcggaacttttccagtttcgcgaaaaatatcgccactggcaaggaatgggtttgagatggcgaagtctgtcctaaaagcagcgcctgtagttgtagggttgacggccttgatggagcgtcatgccgatgccctctcgagccaacttcaagcacatcatcttaaggttttcccgccgcattccgagaagggcattcgaacattcgggccatcggaggcgtccaagctgctcggcgttggcgagtcatatttacggcagaccgcgtctgagatgccagagttgaatgttagcatgagcccgggtggcaggcgaatgttctcaattgaagatatccatgcgattcggaagtatatggatcaggtcggccgcgggaaccggcgctacctgccacatcgtcgaggcggcgagcagcttcaggttatctctgtgatgaatttcaaaggtgggtcgggtaagaccaccaccgccgcgcatctggcgcagtacctcgctatgcgcggatatcgagtcttggccattgatctcgatcctcaagcgagcctttctgcactctttgggagccaaccggagacggacgttggcccgaacgaaacgctctacggcgctataaggtatgatgatgagcaggtggcaatcgaacgagtcgtccgagggacttacattcccgacctccacctgattcctggtaatcttgagctgatggagtttgaacacgatacgccacgcgcgctgatgaaccgcaaagagggcgacacgctcttttatggtcgcatcagccaagtaattgaagatatcgcggataactatgacgtcgtggtcatcgactgccctccccagcttgggtatctcacgctatccgcattgactgcggcgacgtccattcttgtcacggtccatccgcagatgctggatgtgatgtcgatgaaccagtttctggcaatgacatcgaaccttttgcgtgaaatcgagaatgctggcgccaagttcaagtttaattggatgcgctatctgataacccgtttcgaaccgagcgacggaccacagaaccaaatggtaggttatctgcggtcgatttttggcgaaaatgtcctcaattttccgatgcttaaaaccaccgcggtttcggacgctggcctgacaaaccagactctattcgaagtggagcgtggcctgttcacgcgctcgacctatgatcgagccttggaggcgatgaacgccgtcaacgacgagatcgaaacactgatcaaaaaagcatggggtaggcccacatgagccggaagcacatccttggcgtctcaactgacgcccctgagacgtcgcccgccgacaataggacggcaaagaaccgctccatgccgctcctcggcgtaacaaggaaggagcgcgatccggcaacgaagctcacagcgaacattggtaacgcactgcgagagcaaaacgatcgtcttagccgtgccgaagagatcgagcggcgtctcgctgaaggtcaggcagtgatagagttggatgcctcgtcaatagaaccgtctttcgtgcaggatcgtatgcgaggggacattgacgggctccttacttcgatccgggaacaaggacagcaagtcccaatccttgtgcgaccgcatccgagccagccgggccgatatcaggttgccttcggccaccgccggctacgcgccgtttcagaactcggacttccggtcagagcggtcgttcgcgaactgacggacgagcaagtggtcgtagcacagggtcaggaaaacaatgagcgcgaagatcttaccttcatcgaaaaggcgcgcttcgcacatcgcctgaacaggcagttttctcgagagattgtcatcgccgcgatgtcgatcgacaagagcaatttgtccaagatgcttctgctcgttgacgccctcccctctgaactgaccgatgctattggtgccgctcctggtgttggacggccgagttggcaacaacttgccgagctgattgagaaagtttcttcaccggccgacgtggctaaatatgctatgtcggaggaagttcaagcgctgccatcggcagaacgattcaaggcggtgatcgctagtctgaagcccagtcgggttgcgcgtggacttcccgaggtcatggccaccccagacggcaccagaattgcacaggtgacgcagagcaaggccaaactggaaatcacgattgacaggaaggcgacgcccgattttgcgaccttcgtgctcgatcatgtgccagcgctgtatcaagcgtaccacgctgagaaccaacggaaacggggagagtaaaccgcaaaagaaaagagccccctcaacgtcgccgtcgcggaagcccttctgtctctctagcgcgaacagaatcgcatttcctcgaatcctcgtcaagagtttttagcgccgttttggtgagctgatttcctttgcctgctgaaaggtgaaagatgatgcagacaggaagtgtaacgacgccattcgggcggcggccaatgacgcttgcgcttgtgcggcgccagacggcgctggccgatatcaaacaaggcaagacagcggacaagtggaaggtctttagagacgcgtccgcggctatggaactacttggaatccagtccaacagtcttgccgtccttgatgcgctattgagctttcacccggaaacggagttgcgtcaggaggcacagctgatcgtcttcccgtcgaatgctcagcttgcccttcgggcgcatgggatggctggcgcgactttgcgtaggcacatcgccatgctcgtggagtcaggcttgatcgtccggaaggatagcgccaacggaaagcgttacgctcgtaaggatggcgctggtcagatcgagcgcgcgtttggcttcgatttgtctccgcttctcgcgcggtcggaagagctagcgatgatggcacagcaggtgatggccgatcgagcagcattcaggatggccaaagaaagtctgacgatttgccgacgggacgttcggaagctaattacggcagctatggaagagggagcggagggcgactggcaagctgtcgaggaagtctatgtggaacttgtgggtagaattccacgcgccccgacgcttgctgatgtagagtcaattctcgaagagatgtggatgctccaggaagagataatcaaccggttggaaattagagacaattcagaaaataatagcaccaatgctgcccagagcgagcagcacatacagaattcaaaacccgaatccgttaatgaacttgaacctcgctctgaaaaggagcagggcgctaagccgagtgaaatagaccgggcaaggagcgagccgataaaagcgttccccctcgggatgatcctgaaagcatgcccgaccattggcaactatgggccgagcggtgcggttgctagctggcgtgacctcatgtcggctgcggtggtggttcggtctatgctgggggtcagcccgtcggcttaccaagacgcgtgtgaggcaatgggaccggagaatgcggcagcagcgatggcgtgcattttggagcgagcgaacttcatcaattcgcccgggggctatctccgagatctgacacggcggagcgagcttgggaagttttcacttggcccgatgataatggcgctcttgaaggctagcgggcaggggacgttgcggtttggctagaattagcgagtatggagcaggatggtctgtggtcagctgaccacagacctaataggttgaaaacatgagcgttttttggatgatcgacagaccatccgattcccggagtaccaagcgtgctctgatgggagcgataacattactcaacaagcacgaaggccccatgccgatcgttgatcgtgaaggagagcctgctctacatgcggcggtattttgccggccgaggcatgtagtcgcggagcactgcctatttactgccctaggcacaaacgttgactcttggatcgagctggcagacaaagcaataacccacacagaggacgattaatggctgacgaagagatccagaatccgccggacggtactgctgctgccgaagttgagccggctgctcctagaggtagaagagcaaagaaagcaccagccgaaacagcccgcacgggatcgttcaaatccgtgaagccgaaaacccgcggcctcagcaaccgagaaaaactggagaagatcggtcaaatcgaagctcaggtcgctggcggcgcaaccttgaaggacgccgttaagatcgtgggtatttccgttcagacctattatcaatggaagagagctgcggttcaacctgtctcacagaatccggccgtgtctgtttcagttgacgatgaactcggcgagttcatccaactcgaggaggaaaatatgcatc

SEQ ID NO: 108 - DNA, 22277 bp, Artificial sequence
  Synthetic construct
gtggggcatggctgtctccttgaaagcaatttgtcactaacgagggcacccttaagtcaaataaggctgactaaatcagcaatacagaggcagctattcatgccactcggggacgtttttccgcactttactgccacttgtctgcgctgattacaccattgctggcgacagagtgagatcttcgatcccgcgaaattaatacgactcactatagggagaccacaacggtttccctctagaaataattttgtttaactttaagaaggagatatacccatggaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacagcttggatcgatccggctgctaacaaagcccgaaaggaagctgagttggctgctgccaccgctgagcaataactagcataaccccttggggcctctaaacgggtcttgaggggttttttgctgaaaggaggaactatatccggatgatcgggcgcgagatcttttgtaatgtaaccaactagtgcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagcgtacgttggaatcgcttctacaaaactcacagaaacaatcaaacaaacatacacagcgatttattcacacgaacccgaattacaacggtatatatcctgtcagccaacaccaaaacatcaaaaaaatcgggatcaggatcaggatctgcggccgcatcctgcaggtcgactctagaggatcctcatcgctatcaactttgtatagaaaagttgggccgaattcgagctcggtacggccagaatccggtaagtgactagggtcacatcgaattcccataggattggggccagaatggcctagtacccttgtacttttggtttcacctgcatagagaaaacccacaagaatatgacagtctgatttgtcagtctcattctcaagcaacatttctctatccgttactttcatggtgaataacacaatccatcatcaatactttgtgttactcagaaactgaaagttattccgagtcttgcatatctttgggcctactcgtttttctaccattattgctgattgttaagctctcgctacttgaatcggcattgttggagtgggaaggttcaaaaaattggagttatgactagttgtctctttctatgtacgatggagaaaatgaataaacaactgagaaaatggctcttgtttagttgatgatgctcttaagctttccactggttgccatatatgatttgggcatttcactttgatcttaatgggccttgtaaggcccaagactcatgattatctttagttgatgctcttaattaggtgtgggcaaataattcaaactgtatgtacccgaccaaaaccaaagcaaaaataatcgaaccaaaccgaaaatttaaaaataaccgaatgaaaactaaatcctataactgaaagaactgaaaccgaatcaaaatatttaatgtaaccaaaaatatccgaaatataattatattgtcaaaaatattaataatttctagattaaataattaaaaatacttaaaaatttatataaaatagtaaaaatactcgaaaataaccacaaatattcaaaaacaaccgaaatatcccaaaatattcaaagcaaaataaccgaatggataccaaattttaaaaccgaaaaaactggaacaaaaccagaatcgaaccaaaatttcaaaaatcgaataaatactaaactttagaacaaaaaaaaacgataaccgaatgtatacgaaccaaagccgaattagataaccgaacgtccaggactactcttaatctttccgccacttatgatttgggctattactttgtttataatgagccttttcaagctcaagttcatgattgtccgtgagatgagaaactgacttgttggattcgaaaccctagctagtattggttaatacttaatacataaatgacctgcattgacatcatcatccaagaaaataaaaattgtatgcttgagatatttagttttcctagctaggttttctttattttagtaccgaatctttaggtgtgccacgttaatttagacccattttttcatacttaccaactgagtctagtttaatcatgactataatcgtataaaatgattcagtcgacgtcattgcgaacgtatataaaatcatccaaattgacgtcattccaaagaggtaagcatgcttatctaagagtccgagcatactaaacaagacgacattttatttgcactctaaatcaaattttgtattgcctaaagaaaaacaatcaaactcaagtttcttaaaattaatttcattcaaactaatcactttcaatatctcacatattattcatgccatttctatttgtctaaacatgatttaaaaaaaaagtaaaatacaaagattactatgcaaaaactctataaaaaaaaattcaaatttcttatttatttgtgacatcaaattttcaaaataatttttttaattatcggttgatccggtcagtcgataaaaacataaactttcagcgaccgttaaaactttcctactaccgatttagagaaaatcttagcttgaaacgtaattgtaacctgccttcatgcaagtcgcaagatatgtcatcctaagttgtatatgttttctcaaaagatgtatttacttgagaaaatacgtttcaacgttgatggacaaccaattaagaatcaagcacctttcgtaatcaatttaggcttatcgtctaaggtatactgatttacgacagttgactagacttataaggaacaaaataatagaataatttcgtcaagaaaaattgattttggactcatactttacataatattttactcttaaatttatttaagtggctcctcgcatgatcccaaagagcaagcctagactatatggaaaagtttctaaacacttcacctaatcatagagactaagatggtaattcgtaaacgacaaagcctagtgacactgtccattgtaaaattccacatcatattagtattaaacatatacatgtagtttcctgaacacatgtagtatcaaacacacttcgtggcttcttcctcgaaacctggcctagaaggcccgggttaaccttcagcttagaaatgatgtgttttctacacttttctcttcttttttttcttttcatctcacatgaatcaaaaagagaaagcttaattacattaaaggttgatgtgatatttactttctaaatatttgctagaagaaattataatgataacattaaattaagttatagtcatttctatttcggttgtctcccactttctgctatgcttttacaacaacagttcaagatttggaatcgttttctttctccaccaatcgtagtaatacttctttttgtgtttgttgaaattttgcaagattctctcttcctctggttaatacacataacttacttggtaagcttggctgcattttcttttcaagcttttaatcaaagactcactagaaattgcaaaggcaaacataaaattatgtgatcaaactcctactgtgagtttttggttacaaacaaaagttaaaaacaaaagcttgatatttaaaagataaactcaacacatatgcatttgactggcgcacagaagacaattcaagacttgggaaaacagtgagccatcaaaatcgtcagataattcagggaatatattgaatgtggagatgtggtaatcacactattgcacacaaagagtggcaaacaagcggcgcccttggtttggtatagtaagagacaattgttttggactgtttgtgttgccatattcacaaaaatactattgagctatgtatgttaaacattatggtcaatgagtagtagtgaacattcaagtttttttttttttccacttcaagtttttcatcttattattatttttcgttgtgatgcagtagtacggcccatcttcaccagtagtatatcaaagccgaaacagatgacaaattgtttaacatgcacttggattattattgagagttgaaatacaaaggcccgttacaagcccaaacgaaggtacataaaagaaaagcagaaaatgaaaacgaaatcgatagggataagtttttccaactgacggaaacacaaactacaccaggtgaaatagatcacctcccaagtgcatgagacacgaaccaaccacttatcatcagatcacaaaagagctcaaagatctagcgatcgcctaattcagtttgtggccaagctttgatggcaagtcgcaatatctagcgacggccacctcgtgctgctccacataagtctccttgtcggcctcttttatgcgctcgagtctatggtccacgtaatacacgccgggcattttcaagtttttggcaggctttttggagcggtaggtggtcttgaagttacagatgagatggcctccgccgacaagcttcaaggccatgtcggatctaccttcaagaccaccgtcggctgggtaaagcatttcagtattggcttcccagccgagagtcttcttctgcatcacgggaccgtttgatgggaagttcacgccgcggatcttgacgttgtagatcaagcagccgtcttgaagactagtgtcttgggtggcggtcaagactcctccgtcttcgtaggtggtcactctctcccaggtgaatccctctgggaatgactgtttgaagaagtctgggatgccctgggtgtggttgatgaaggttctactcccgtacatgaaggaggtggctagtatgtcgaaggcgaatgggagtggacctccttcgaccaccttgattctcatagtctgggttccctcatagggcttgccctcaccctcagaggtacacttgaagtggtgattattcacggtgccctccatgtataacttcatgtgcatgttctctttaatgagctcctcccccttggacaccatggctgtagagtcaacaatcacaagataaatcagaatcaaaatccatcacgtaatttcaagaagcaatttcgtgaaaaaaaatcctaatctatggccacagaatcaacaaataaggtagttgctaaaggacctgagcaatatctcttgaaataccatacagaatcaacgaataaggcttttatcaacggatctgaacaatttcttgaaaaacgactgaagtatcaacaaataaggctgttgtttaacggatctgaagtagttcatgaaaaaaaccttaatctacgactacagaatcaacaattaaggcttgttgtaaacggatctgaaaatctttatgaaaaaaactctaattagacctaatttacggttataaaatcatcaattaaggacgttcttgcattaataaaagctgaatcttctgattatgaaaatttataatcgatgaaacgatagaaaacacaatcaaatcaacatcatgctgatgtagaacaaacaataaagaagaagaaaaaaaaacggaagaaatctacgaaccttgaaaggagaggtagggaactgcgcaaagagaatgaactaatttgattgcaattgaagtgcgattagggtcgaggggtgtgggggcattttatagcatatgcggtggaaccgttctccaatcatattgtgacgcgtgcccatgtatggtgtgacttggtgtttatgacacagatgatatttcggggagtccttcgtagttgacggtttcgtaatcttgacggagtcagagatgtaccttcaccgcttcacgcttggctttatccgttaccacggcgttattaaattgggcccgcacccgttgcaagttaggaccacagtgtccattacctgaacggtcggctgctaccagtattttacattattaaaatctatggaaaagctgtcacgctagatttttttttttttttttatggataagaaaagactaataggaaagctttcttactccactaaagtctttaataattattttttcaattttcaaataaaatcataatcatcccactaaattctttctcatttgtttttcactttgtaagatattcttccgtagatttttataagtaattctttaagatacatagcataataaattgtatacttttagttacagtctatataaaattagtcatttaaaaaatatagccttaatgatttttttaaaatgaagttatttttttctaatttttctttcttatttattatcgaatgattttttctactaatcgtttagggaagagttttatttttctaatgacgagatgtgttaaatgatgcaacttgaaggcgacatattttttaccaataaaataaaactaaaagatagcttgttgacaaaaacaataattgatgttaaagaaaacgtaagggcaatgggtatcatctaattgttggacaagttgtcttctaaggctaggtaagcttttgttttttattagctgaaatatttatttaattgttctataaataaattttttaaaatgatttttaatgtttttaaatattatttaaaataatttttttaaaattttaacattttagtttttaattattttttatcttacttaaattaattataatttattattttctaccattttatactttccaattaattttatcgaagcattaataccatctggtattttgtcactgcttcgtatgattgtttattaaattttagcttctttcacattggagatgctgggcggtgtgagttacagcatggtgtgaagttaaggtggtttgattatggaacccgaaggtgttggtgcaaggtggataaaattgcttgccaggagatacataaaatgatttacaaaatgaaataaagaataaataaatagtcaagttcaaatttaaatcaaggattagaattatttttccgtacatgatgtaaccgcaatcaccccctgctgaatccagacgggttaccagagctggtcaccccatacgattggaagcttcaagtttgtacaaaaaagcaggctccggccagaatccggtaagtgactagggtcacatcgaattcccataggattggggccagaatggccatctggattcagcaggggcccagctgatgggtctagaactagaaacgtgatgccacttgttattgaagtcgattacagcatctattctgttttactatttataactttgccatttctgacttttgaaaactatctctggatttcggtatcgctttgtgaagatcgagcaaaagagacgttttgtggacgcaatggtccaaatccgttctacatgaacaaattggtcacaatttccactaaaagtaaataaatggcaagttaaaaaaggaatatgcattttactgattgcctaggtgagctccaagagaagttgaatctacacgtctaccaaccgctaaaaaaagaaaaacattgaatatgtaacctgattccattagcttttgacttcttcaacagattctctacttagatttctaacagaaatattattactagcacatcattttcagtctcactacagcaaaaaatccaacggcacaatacagacaacaggagatatcagactacagagatagatagatgctactgcatgtagtaagttaaataaaaggaaaataaaatgtcttgctaccaaaactactacagactatgatgctcaccacaggccaaatcctgcaactaggacagcattatcttatatatattgtacaaaacaagcatcaaggaacatttggtctaggcaatcagtacctcgttctaccatcaccctcagttatcacatccttgaaggatccattactgggaatcatcggcaacacatgctcctgatggggcacaatgacatcaagaaggtaggggccaggggtgtccaacattctctgaattgccgctctaagctcttccttcttcgtcactcgcgctgccggtatcccacaagcatcagcaaacttgagcatgtttgggaatatctcgctctcgctagacggatctccaagataggtgtgagctctattggacttgtagaacctatcctcccactgaaccaccatacccaaatgctgattgttcaacaacaatatcttaactgggagattctccactcttatagtggccaactcctgaacattcatgatgaaactaccatccccatcaatgtcaaccacaacagccccagggttagcaacagcagcaccaatagccgcaggcaatccaaaacccatggctccaagaccccctgaggtcaaccactgcctcggtctcttgtacttgtaaaactgcgcagcccacatttgatgctgcccaaccccagtactaacaatagcatctccattagtcaactcatcaagaacctcgatagcatgctgcggagaaatcgcgtcctggaatgtcttgtaacccaatggaaacttgtgtttctgcacattaatctcttctctccaacctccaagatcaaacttaccctccactcctttctcctccaaaatcatattaattcccttcaaggccaacttcaaatccgcgcaaaccgacacgtgcgcctgcttgttcttcccaatctcggcagaatcaatatcaatgtgaacaatcttagccctactagcaaaagcctcaagcttcccagtaacacggtcatcaaaccttaccccaaaggcaagcaacaaatcactattgtcaacagcatagttagcataaacagtaccatgcatacccagcatctgaagggaatattcatcaccaataggaaaagttccaagacccattaaagtgctagcaacgggaataccagtgagttcaacaaagcgcctcaattcagcactggaattcaaactgccaccgccgacgtagagaacgggcttttgggcctccatgatgagtctgacaatgtgttccaattgggcctcggcggggggcctgggcagcctggcgaggtaaccggggaggttaacgggctcgtcccaattaggcacggcgagttgctgctgaacgtctttgggaatgtcgatgaggaccggaccggggcggccggaggtggcgacgaagaaagcctcggcgacgacgcgggggatgtcgtcgacgtcgaggatgaggtagttgtgcttcgtgatggatctgctcacctccacgatcggggtttcttggaaggcgtcggtgccgatcatccggcggctgacctggccggtgatggcgacgactgggacgctgtccattaaagcgtcggcgaggccgctcacgaggttggtggcgccggggccggaggtggcaatgcagacgccggggaggccggaggaacgcgcgtagccttcggcggcgaagacgccgccctgctcgtggcgcgggagcacgttgcggatggcggcggagcgcgtgagcgcctggtggatctccatcgacgcaccgccggggtacgcgaacaccgtcgtcacgccctgcctctccagcgcctccacaaggatgtccgcgcccttgcgaggttcgccggaggcgaaccgtgacacgaagggctccgtggtcggcgcttccttggtgaagggcgccgccgtggggggtttggagatggaacatttgattttgagagcgtggttgggtttggtgagggtttgatgagagagagggagggtggatctagtaatgcgtttggggaaggtggggtgtgaagaggaagaagagaatcgggtggttctggaagcggtggccgccattgtgttgtgtggcatggttatacttcaaaaactgcacaacaagcctagagttagtacctaaacagtaaatttacaacagagagcaaagacacatgcaaaaatttcagccataaaaaaagttataatagaatttaaagcaaaagtttcattttttaaacatatatacaaacaaactggatttgaaggaagggattaattcccctgctcaaagtttgaattcctattgtgacctatactcgaataaaattgaagcctaaggaatgtatgagaaacaagaaaacaaaacaaaactacagacaaacaagtacaattacaaaattcgctaaaattctgtaatcaccaaaccccatctcagtcagcacaaggcccaaggtttattttgaaataaaaaaaaagtgattttatttctcataagctaaaagaaagaaaggcaattatgaaatgatttcgactagatctgaaagtcaaacgcgtattccgcagatattaaagaaagagtagagtttcacatggatcctagatggacccagttgaggaaaaagcaaggcaaagcaaaccagaagtgcaagatccgaaattgaaccacggaatctaggatttggtagagggagaagaaaagtaccttgagaggtagaagagaagagaagagcagagagatatatgaacgagtgtgtcttggtctcaactctgaagcgatacgagtttagaggggagcattgagttccaatttatagggaaaccgggtggcaggggtgagttaatgacggaaaagcccctaagtaacgagattggattgtgggttagattcaaccgtttgcatccgcggcttagattggggaagtcagagtgaatctcaaccgttgactgagttgaaaattgaatgtagcaaccaattgagccaaccccagcctttgccctttgattttgatttgtttgttgcatactttttatttgtcttctggttctgactctctttctctcgtttcaatgccaggttgcctactcccacaccactcacaagaagattctactgttagtattaaatattttttaatgtattaaatgatgaatgcttttgtaaacagaacaagactatgtctaataagtgtcttgcaacattttttaagaaattaaaaaaaatatatttattatcaaaatcaaatgtatgaaaaatcatgaataatataattttatacatttttttaaaaaatcttttaatttcttaattaatatcttaaaaataatgattaatatttaacccaaaataattagtatgattggtaaggaagatatccatgttatgtttggatgtgagtttgatctagagcaaagcttactagtgatgcatattctatagtgtcacctaaatctgcggccgggcacccagctttcttgtacaaagtggccgttaacggatcggccgcagatttaggtgacactatagaatatgcatcactagtattccaatcccacaaaaatctgagcttaacagcacagttgctcctctcagagcagaatcgggtattcaacaccctcatatcaactactacgttgtgtataacggtccacatgccggtatatacgatgactggggttgtacaaaggcggcaacaaacggcgttcccggagttgcacacaagaaatttgccactattacagaggcaagagcagcagctgacgcgtacacaacaagtcagcaaacagacaggttgaacttcatccccaaaggagaagctcaactcaagcccaagagctttgctaaggccctaacaagcccaccaaagcaaaaagcccactggctcacgctaggaaccaaaaggcccagcagtgatccagccccaaaagagatctcctttgccccggagattacaatggacgatttcctctatctttacgatctaggaaggaagttcgaaggtgaaggtgacgacactatgttcaccactgataatgagaaggttagcctcttcaatttcagaaagaatgctgacccacagatggttagagaggcctacgcagcaggtctcatcaagacgatctacccgagtaacaatctccaggagatcaaataccttcccaagaaggttaaagatgcagtcaaaagattcaggactaattgcatcaagaacacagagaaagacatatttctcaagatcagaagtactattccagtatggacgattcaaggcttgcttcataaaccaaggcaagtaatagagattggagtctctaaaaaggtagttcctactgaatctaaggccatgcatggagtctaagattcaaatcgaggatctaacagaactcgccgtgaagactggcgaacagttcatacagagtcttttacgactcaatgacaagaagaaaatcttcgtcaacatggtggagcacgacactctggtctactccaaaaatgtcaaagatacagtctcagaagaccaaagggctattgagacttttcaacaaaggataatttcgggaaacctcctcggattccattgcccagctatctgtcacttcatcgaaaggacagtagaaaaggaaggtggctcctacaaatgccatcattgcgataaaggaaaggctatcattcaagatgcctctgccgacagtggtcccaaagatggacccccacccacgaggagcatcgtggaaaaagaagacgttccaaccacgtcttcaaagcaagtggattgatgtgacatctccactgacgtaagggatgacgcacaatcccactatccttcgcaagacccttcctctatataaggaagttcatttcatttggagaggacacgctcgagctcatttctctattacttcagccataacaaaagaactcttttctcttcttattaaaccctgcagatgagccccgagagaaggccagctgacattcgccgtgcaactgaggctgatatgcctgctgtgtgtacaattgtcaaccactatatcgaaacttcaacagttaactttaggactgaaccacaagagccccaagagtggaccgacgatcttgtgagattgcgcgaaaggtacccttggcttgttgcagaagtggacggagaagtggcaggcatcgcctatgctggtccctggaaggccaggaatgcctacgattggactgcagagtctacagtttacgtgtccccacgtcatcagagaaccgggttaggctcaacattgtatacccacctcttgaaaagtctcgaagctcaaggtttcaaatccgtagttgctgtcattgggctccctaatgatccttctgttcgcatgcatgaggctcttggttacgccccaaggggaatgcttagagcagcaggctttaagcatggaaactggcatgatgttggattctggcagttggatttcagtttacctgttccaccaagaccagtactgcctgtgaccgaaatagtttaagtttaaaccgcgcctaggaaacttatctctgttatgaatcagaagaagttcatgtctcgtttcatttaaaactttggtggtttgtgttttggggccttgtaaagcccctgatgaataattgttcaactatgtttccgttcctgtgttatacctttctttctaatgagtaatgacatcaaacttcttctgtattgaaattatgtccttgtgagtctctttatcatcgtttcgtctttacattatatgtgctacttttgtctaatgagcctgaaaagtggctccaatggtacgcactggaagatttgttggcttctggtagatatagcgacagtgttgagcttgtaatatcatgtctcttattgctaaattagttcctttcttaacagaaaccttcaaagtttttgtttttgttttcatttacctaatgtacacatacgctggccatgactaacaacatgtccaggcttagagcatatttttttctagcttaaattgttaacttgtcattcagtaaaatccgagaattgtgaagctctaattgaagctaattcgttttataaagtcagttaaaaagtatactaaattatccaacttttcttcaaaatctcaaaattctatgacaaaacgatagtctttgtttatgtcagtaccacaaagaggtggaaaaaaacaccaaaaaaacaataagcaaactatacactgagaagaaaaataaaagagagctcaatagatgttttatactaacggtagattagatcaaagatccaagctttactctacatagagcagaacccagaatcccttcatatctcttttattctagcaccgataatctactgaaaagaagacacttagagctctgtctctttgtcaaagaagtcccagccgtcatccagaagctccttacgttcattaacagaggtaccggcggccgcgggcaactttattatacaaagttgatagattgtatgaattcatttacaattgaatatatcctgccattttacacctcgatatatcctgccacaaattccatgtacacagtacattaaaaacgtccgcaatgtgttattaagttgtctaagcgtcaatttgtttacaccacaatatatcctgccaccagccagccaacagctccccgaccggcagctcggcacaaaatcaccactcgatacaggcagcccatcagtccactagagggcccgccgagaatgaacgccaagaggaacaagcatgaaaccgcaccaggacggccaggacgaaccgtttttcattaccgaagagatcgaggcggagatgatcgcggccgggtacgtgttcgagccgcccgcgcacgtctcaaccgtgcggctgcatgaaatcctggccggtttgtctgatgccaagctgggcggcctggccgcccagcttggccgctgaagaaaccgagcgccgccgtctaaaaaggtgatgtgtatttgagtaaaacagcttgcgtcatgcggtcgctgcgtatatgatgcgatgagtaaataaacaaatacgcaaggggaacgcatgaaggttatcgctgtacttaaccagaaaggcgggtcaggcaagacgaccatcgcaacccatctagcccgcgccctgcaactcgccggggccgatgttctgttagtcgattccgatccccagggcagtgcccgcgattgggcggccgtgcgggaagatcaaccgctaaccgttgtcggcatcgaccgcccgacgattgaccgcgacgtgaaggccatcggccggcgcgacttcgtagtgatcgacggagcgccccaggcggcggacttggctgtgtccgcgatcaaggcagccgacttcgtgctgattccggtgcagccaagcccttacgacatatgggccaccgccgacctggtggagctggttaagcagcgcattgaggtcacggatggaaggctacaagcggcctttgtcgtgtcgcgggcgatcaaaggcacgcgcatcggcggtgaggttgccgaggcgctggccgggtacgagctgcccattcttgagtcccgtatcacgcagcgcgtgagctacccaggcactgccgccgccggcacaaccgttcttgaatcagaacccgagggcgacgctgcccgcgaggtccaggcgctggccgctgaaattaaatcaaaactcatttgagttaatgaggtaaagagaaaatgagcaaaagcacaaacacgctaagtgccggccgtccgagcgcacgcagcagcaaggctgcaacgttggccagcctcgcagacacgccagccatgaagcgggtcaactttcagttgccggcggaggatcacaccaagctgaagatgtacgcggtacgccaaggcaagaccattaccgagctgctatctgaatacatcgcgcagctaccagagtaaatgagcaaatgaataaatgagtagatgaattttagcggctaaaggaggcggcatggaaaatcaagaacaaccaggcaccgacgccgtggaatgccccatgtgtggaggaacgggcggttggccaggcgtaagcggctgggttgcctgccggccctgcaatggcactggaacccccaagcccgaggaatcggcgtgagcggtcgcaaaccatccggcccggtacaaatcggcgcggcgctgggtgatgacctggtggagaagttgaaggcagcgcaggccgcccagcggcaacgcatcgaggcagaagcacgccccggtgaatcgtggcaagcagccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggcaggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctagctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagccgaagagctgcaaaaagcgcctacccttcggtcgctgcgctccctacgccccgccgcttcgcgtcggcctatgcatataattgtggtttcaaaatcggctccgtcgatactatgttatacgccaactctgaaaacaactttgaaaaagctgttttctggtatttaaggttttagaatgcaaggaacagtgaattggagttcgtcttgttataattagcttcttgggggatctttaaatactgtagaaaagaggaaggaaataataaatggctaaaatgagaatatcaccggaattgaaaaaactgatcgaaaaataccgctgcgtaaaagatacggaaggaatgtctcctgctaaggtatataagctggtgggagaaaatgaaaacctatatttaaaaatgacggacagccggtataaagggaccacctatgatgtggaacgggaaaaggacatgatgctatggctggaaggaaagctgcctgttccaaaggtcctgcactttgaacggcatgatggctggagcaatctgctcatgagtgaggccgatggcgtcctttgctcggaagagtatgaagatgaacaaagccctgaaaagattatcgagctgtatgcggagtgcatcaggctctttcactccatcgacatatcggattgtccctatacgaatagcttagacagccgcttagccgaattggattacttactgaataacgatctggccgatgtggattgcgaaaactgggaagaagacactccatttaaagatccgcgcgagctgtatgattttttaaagacggaaaagcccgaagaggaacttgtcttttcccacggcgacctgggagacagcaacatctttgtgaaagatggcaaagtaagtggctttattgatcttgggagaagcggcagggcggacaagtggtatgacattgccttctgcgtccggtcgatcagggaggatatcggggaagaacagtatgtcgagctattttttgacttactggggatcaagcctgattgggagaaaataaaatattatattttactggatgaattgttttagtacctagatacttcgctcgtgaaaagcagcgctcagggggctagcttggaagatcgcaccctgattgacatgctcgcaaccgcagttgatgtcatcgtacccttccgtgcccacggtgacatttacgaggtgggcgaaatctggctcgctgccgatgcgcgtcggcgcggtgagacaataggcgatcttcttaaccagcagtagttgtgatccatgtttctaaatgccgcatggcgcgttgtagaattacgtttgtagcaatgctcagcaatctttgtcatcaaacggagacatctagtttgcatttctgtcgtgcgcggtttggtcgaaatcttgccgaaatgcccgtgtagtgagagaaaattaaagagtggagtctagcaaatacaacctttacgtgtataaattctgttgagctgcaaatggctggccaggagcctagattgagaggtgaaccgttgaaacacgttcttgtcatcgatgacgatgtcgctatgcggcatcttatagtcgagtatcttacgatccatgcctttaaggtgactgcggtagccgacagcaagcagttcaatcgtgtactctgctccgagacggtcgatgtcgtggtcgtcgatcttaatttgggtcgcgaagatgggcttgaaattgttcgtagtctggccacgaagtccgatgttccaatcataattattagcggcgctcgcctcgaagaggcggacaaagttattgcgctcgagttgggagcaaccgattttattgccaagccttttgggacgcgggaatttctggcgcgcatccgtgttgcgttacgcgtgcggcccagtgtcgcgcgaaccaaagatcgacgctcatttagtttcgctgactggacacttaatctcaggcgacgccgcttgatttcggaagagggcagtgaggtgaaactcacggcaggtgagtttaatctcctggttgctttcctggagaagccgcgcgacgtcctatcccgggagcagcttctgatcgccagtcgggtacgcgaggaggaggtgtatgacagaagtattgatgtcctcattttgcggctgcgccggaagcttgagggggacccgacgacccctcagttaatcaagactgcaagaggtgctggctatttctttgacgctgacgtggatgtttcgtacgggggtgtgatggcggcctgaggtagaggtgcatttcgcctttagcaatctgttcccaacgtgagcagattgctatgcggcttggcaaagctgcctttcctcggtactatccgagcggccggccgcatcgtaattttaagacgcagtctattatttccaaaggaattaagaagctgttctccagcataaaatttgaaaacagaatgatgtctgaagcacttgccgccctgccacaacaagacaaagctaaaaacaattgcgaacatcttattcaaatgaagacaggtgtgacgcggagctggtgcaaactaatacattccgaatggatgaccttcgaatccgtcgtaagcggctgcgttaactcgagggaatttctgttcttgtcggcgtgcatggatgagatactcctgagcgatcccatgaatcaacttatcctccatatctgcgtcaagctgcaatagcatatcggatgtgatctggttctggctagcaaacaacatggcatatcgatatccatcgatctctttcagtatgggcctcagccgaggctctttccaaagatcaaccaactcttggataatagaaaggccagcagcagggcgtaacatctgcttaactctggccttggccacgttcatgaaggtctcctcgtctgctaactcgtggcgaataatatgccaacgaaaatccgcactccaataactgctttgcgccatgcacttgagcaacgagatagatcctccctcaagaataagcccgccgtgggcctcataattatacacctcccccatcagcctttcatgagcttgcttggctgcgatgatacccttcaccagaggccgatcatcaaggtatagacggctcgttcctttcagttcttccactgttggtcgtccgcttccggttgacagctgaggacaacattggacccgatcgagcgaaaggactggaagcccagtctgctgggcaagagctaccgcggtcgacgtctttcctgtgcaagttggaccgaaaattagacgcagatccataagttttttgcggtatcttgaatacaaattgactttttggattagagaagtgtactaccagaggcggttatattgcctcctcgagattccttattgaagagcaactggctttaccgtctccccaaagggcaatttgtttttcaacaaagt

SEQ ID NO: 109 - DNA, 40301 bp, Artificial sequence
  Synthetic construct
gcatataattgtggtttcaaaatcggctccgtcgatactatgttatacgccaactctgaaaacaactttgaaaaagctgttttctggtatttaaattaaaaatgaagcgtacgttggaatcgcttctacaaaactcacagaaacaatcaaacaaacatacacagcgatttattcacacgaacccgaattacaacggtatatatcctgtcagccaacaccaaaacatcaaaaaaatcgggatcaggatcaggatctgcggccgcatcctgcaggtcgactctagaggatcctcatcgctatcaactttgtatagaaaagttgggccgaattcgagctcggtacggccagaatccggtaagtgactagggtcacatcgaattcccataggattggggccagaatggccgcggccgcatcaggatattcttgtttaagatgttgaactctatggaggtttgtatgaactgatgatctaggaccggataagttcccttcttcatagcgaacttattcaaagaatgttttgtgtatcattcttgttacattgttattaatgaaaaaatattattggtcattggactgaacacgagtgttaaatatggaccaggccccaaataagatccattgatatatgaattaaataacaagaataaatcgagtcaccaaaccacttgccttttttaacgagacttgttcaccaacttgatacaaaagtcattatcctatgcaaatcaataatcatacaaaaatatccaataacactaaaaaattaaaagaaatggataatttcacaatatgttatacgataaagaagttacttttccaagaaattcactgattttataagcccacttgcattagataaatggcaaaaaaaaacaaaaaggaaaagaaataaagcacgaagaattctagaaaatacgaaatacgcttcaatgcagtgggacccacggttcaattattgccaattttcagctccaccgtatatttaaaaaataaaacgataatgctaaaaaaatataaatcgtaacgatcgttaaatctcaacggctggatcttatgacgaccgttagaaattgtggttgtcgacgagtcagtaataaacggcgtcaaagtggttgcagccggcacacacgagtcgtgtttatcaactcaaagcacaaatacttttcctcaacctaaaaataaggcaattagccaaaaacaactttgcgtgtaaacaacgctcaatacacgtgtcattttattattagctattgcttcaccgccttagctttctcgtgacctagtcgtcctcgtcttttcttcttcttcttctataaaacaatacccaaagagctcttcttcttcacaattcagatttcaatttctcaaaatcttaaaaactttctctcaattctctctaccgtgatcaaggtaaatttctgtgttccttattctctcaaaatcttcgattttgttttcgttcgatcccaatttcgtatatgttctttggtttagattctgttaatcttagatcgaagacgattttctgggtttgatcgttagatatcatcttaattctcgattagggtttcatagatatcatccgatttgttcaaataatttgagttttgtcgaataattactcttcgatttgtgatttctatctagatctggtgttagtttctagtttgtgcgatcgaatttgtcgattaatctgagtttttctgttaattaacagatggcccacagcaagcacggcctgaaggaggagatgaccatgaagtaccacatggagggctgcgtgaacggccacaagttcgtgatcaccggcgagggcatcggctaccccttcaagggcaagcagaccatcaacctgtgcgtgatcgagggcggccccctgcccttcagcgaggacatcctgagcgccggcttcaagtacggcgaccggatcttcaccgagtacccccaggacatcgtggactacttcaagaacagctgccccgccggctacacctggggccggagcttcctgttcgaggacggcgccgtgtgcatctgtaacgtggacatcaccgtgagcgtgaaggagaactgcatctaccacaagagcatcttcaacggcgtgaacttccccgccgacggccccgtgatgaagaagatgaccaccaactgggaggccagctgcgagaagatcatgcccgtgcctaagcagggcatcctgaagggcgacgtgagcatgtacctgctgctgaaggacggcggccggtaccggtgccagttcgacaccgtgtacaaggccaagagcgtgcccagcaagatgcccgagtggcacttcatccagcacaagctgctgcgggaggaccggagcgacgccaagaaccagaagtggcagctgaccgagcacgccatcgccttccccagcgccctggcctgagatccagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgccacctagtacccttgtacttttggtttcacctgcatagagaaaacccacaagaatatgacagtctgatttgtcagtctcattctcaagcaacatttctctatccgttactttcatggtgaataacacaatccatcatcaatactttgtgttactcagaaactgaaagttattccgagtcttgcatatctttgggcctactcgtttttctaccattattgctgattgttaagctctcgctacttgaatcggcattgttggagtgggaaggttcaaaaaattggagttatgactagttgtctctttctatgtacgatggagaaaatgaataaacaactgagaaaatggctcttgtttagttgatgatgctcttaagctttccactggttgccatatatgatttgggcatttcactttgatcttaatgggccttgtaaggcccaagactcatgattatctttagttgatgctcttaattaggtgtgggcaaataattcaaactgtatgtacccgaccaaaaccaaagcaaaaataatcgaaccaaaccgaaaatttaaaaataaccgaatgaaaactaaatcctataactgaaagaactgaaaccgaatcaaaatatttaatgtaaccaaaaatatccgaaatataattatattgtcaaaaatattaataatttctagattaaataattaaaaatacttaaaaatttatataaaatagtaaaaatactcgaaaataaccacaaatattcaaaaacaaccgaaatatcccaaaatattcaaagcaaaataaccgaatggataccaaattttaaaaccgaaaaaactggaacaaaaccagaatcgaaccaaaatttcaaaaatcgaataaatactaaactttagaacaaaaaaaaacgataaccgaatgtatacgaaccaaagccgaattagataaccgaacgtccaggactactcttaatctttccgccacttatgatttgggctattactttgtttataatgagccttttcaagctcaagttcatgattgtccgtgagatgagaaactgacttgttggattcgaaaccctagctagtattggttaatacttaatacataaatgacctgcattgacatcatcatccaagaaaataaaaattgtatgcttgagatatttagttttcctagctaggttttctttattttagtaccgaatctttaggtgtgccacgttaatttagacccattttttcatacttaccaactgagtctagtttaatcatgactataatcgtataaaatgattcagtcgacgtcattgcgaacgtatataaaatcatccaaattgacgtcattccaaagaggtaagcatgcttatctaagagtccgagcatactaaacaagacgacattttatttgcactctaaatcaaattttgtattgcctaaagaaaaacaatcaaactcaagtttcttaaaattaatttcattcaaactaatcactttcaatatctcacatattattcatgccatttctatttgtctaaacatgatttaaaaaaaaagtaaaatacaaagattactatgcaaaaactctataaaaaaaaattcaaatttcttatttatttgtgacatcaaattttcaaaataatttttttaattatcggttgatccggtcagtcgataaaaacataaactttcagcgaccgttaaaactttcctactaccgatttagagaaaatcttagcttgaaacgtaattgtaacctgccttcatgcaagtcgcaagatatgtcatcctaagttgtatatgttttctcaaaagatgtatttacttgagaaaatacgtttcaacgttgatggacaaccaattaagaatcaagcacctttcgtaatcaatttaggcttatcgtctaaggtatactgatttacgacagttgactagacttataaggaacaaaataatagaataatttcgtcaagaaaaattgattttggactcatactttacataatattttactcttaaatttatttaagtggctcctcgcatgatcccaaagagcaagcctagactatatggaaaagtttctaaacacttcacctaatcatagagactaagatggtaattcgtaaacgacaaagcctagtgacactgtccattgtaaaattccacatcatattagtattaaacatatacatgtagtttcctgaacacatgtagtatcaaacacacttcgtggcttcttcctcgaaacctgtccgagcttcaagtttgtacaaaaaagcaggctccggccagaatggcccggaccgggttaccgaattcgagctcggtaccctgggatccaattccaatcccacaaaaatctgagcttaacagcacagttgctcctctcagagcagaatcgggtattcaacaccctcatatcaactactacgttgtgtataacggtccacatgccggtatatacgatgactggggttgtacaaaggcggcaacaaacggcgttcccggagttgcacacaagaaatttgccactattacagaggcaagagcagcagctgacgcgtacacaacaagtcagcaaacagacaggttgaacttcatccccaaaggagaagctcaactcaagcccaagagctttgctaaggccctaacaagcccaccaaagcaaaaagcccactggctcacgctaggaaccaaaaggcccagcagtgatccagccccaaaagagatctcctttgccccggagattacaatggacgatttcctctatctttacgatctaggaaggaagttcgaaggtgaaggtgacgacactatgttcaccactgataatgagaaggttagcctcttcaatttcagaaagaatgctgacccacagatggttagagaggcctacgcagcaggtctcatcaagacgatctacccgagtaacaatctccaggagatcaaataccttcccaagaaggttaaagatgcagtcaaaagattcaggactaattgcatcaagaacacagagaaagacatatttctcaagatcagaagtactattccagtatggacgattcaaggcttgcttcataaaccaaggcaagtaatagagattggagtctctaaaaaggtagttcctactgaatctaaggccatgcatggagtctaagattcaaatcgaggatctaacagaactcgccgtgaagactggcgaacagttcatacagagtcttttacgactcaatgacaagaagaaaatcttcgtcaacatggtggagcacgacactctggtctactccaaaaatgtcaaagatacagtctcagaagaccaaagggctattgagacttttcaacaaaggataatttcgggaaacctcctcggattccattgcccagctatctgtcacttcatcgaaaggacagtagaaaaggaaggtggctcctacaaatgccatcattgcgataaaggaaaggctatcattcaagatgcctctgccgacagtggtcccaaagatggacccccacccacgaggagcatcgtggaaaaagaagacgttccaaccacgtcttcaaagcaagtggattgatgtgacatctccactgacgtaagggatgacgcacaatcccactatccttcgcaagacccttcctctatataaggaagttcatttcatttggagaggacacgctcgagctcatttctctattacttcagccataacaaaagaactcttttctcttcttattaaaccatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacctaaagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgatgtcgagggggggcccggtaccggcgcatcgatgggccctggccgaagcttggtcacccggtccgggcctagaaggccgatctcccgggcacccagctttcttgtacaaagtggccgttaacggatcggccagaatggcccggaccgggttaccgaattcgagctcggtaccctgggatccgatatcgatgggccctggccgaagcttggtcacccggtccgggcctagaaggccagcttcggccgccccgggcaactttattatacaaagttgatagattgtatgaattcatttacaattgaatatatcctgccattttacacctcgatatatcctgccacaaattccatgtacacagtacattaaaaacgtccgcaatgtgttattaagttgtctaagcgtcaatttgtttacaccacaatatatcctgccaccagccagccaacagctccccgaccggcagctcggcacaaaatcaccactcgatacaggcagcccatcagtccactagagggcccgccgagaatgaacgccaagaggaacaagcatgaaaccgcaccaggacggccaggacgaaccgtttttcattaccgaagagatcgaggcggagatgatcgcggccgggtacgtgttcgagccgcccgcgcacgtctcaaccgtgcggctgcatgaaatcctaggaaatatcagccgcttgtgtgttcaattcttctctgtttcacttgaaacaaattgaatagatattcccgctttcaaagccatttacaaatcctctcgtgcagcctaacgccattggcgtggaacaagcgttggcacgaggaagtaagtgcgatgaacggaaggtattcaccgacgcggcaggattttaagacaggcgcgaagccttggtctatattagcccttatcgttgccgcaatgattttcgcgttcatggcggttgcgtcctggcaggacaatgggactacccaggcaatccttagccaaatacgatcgattaacgctgacagcgcctcactgcagcgcgatgtactccgcgctcacacgggcaccgtggcgaactaccgccccattatctccaggctgggagctctgcggaagaatctggaagatttgaagcaattatttaggcaatctcatattgtaagtgagagcaatgctgctcaactgctacgccggctagaagtgtctctaaattcggctgacgcggcggtcgccgcctttggtgcgcaaaatgtccgcctgcaagattcgctggccagtttcactcgtgctttaagcaatcttccaggaaaggcctcaggcgatcagactttagaaaaaccaacagaattggctagcatgatgctccaatttcttcggcaaccaagcccggctatttcattcgagatcagccttgaactagagaggctccaaaaacaacgcggtcttgatgaagctcccgtgcgcatactttcgcgtgaaggtcccattatcttatcgcttttgccacaggtgaacgatctggtgaacatgattcagacgtctgacaccgcagaaattgcggaaatgttgcagcgtgagtgtttggaggtctatagcttgaaaaatgtggaggagcggagcgcacgtatctttcttgggtccgcttcagtgggtctttgcctgtacatcatcaccttagtctataggctacgcaaaaaaaccgattggttagcgcggcgtttagattacgaagagctaatcaaagagatcggagtatgttttgaaggtgaggcggccactacgtcgtccgcgcaagctgcacttggtattattcagcgcttctttgatgccgatacgtgcgcgttagctctagtggaccatgaccgtaggtgggctgtcgaaacattcggtgcgaagcacccaaaacccgtgtgggacgacagggtgctacgcgaaatagtctctcgtaccaaagcgaacgaacgggcgacggtattccgcatcgtatcgacgcaaaaaatcgtacatttgcctcccgaaattccaggtctttcgatactactggctcacaaatccacagataaactaattgcggtttgttcactgggttaccaaagctatcgccctcgaccttgccaaggcgaaattcagcttcttgaactcgccaccgcctgcctctgtcactatatcgatgttcggcgtaagcagaccgaatgcgacgttttggccagacgattggagcatgcgcaacgccttgaggcagttggtacacttgccggcggaatagcacatgaatttaataacattttggggtcaatcctcgggcacgcagaattggcccaaaactcggtgtctcgaacatctgtcacccgaagatacattgactatatcatttcgtcaggcgacagagccatgctcattatcgatcagatcttgacgctgagccgaaaacaagagcgcgtgatcaagccatttagtgtctcagagcttgtgaccgaaatcgctcccttgctacgtatggctcttcccccaaccatcgagcttagtttcagatttgatcaaatgcagagcgtgatcgaaggaagcccgcttgaacttcaacaggtactaattaacctctgcaagaatgcttcccaagccatgactgcaaatggtcaaatcgacatcttcgtcggccaagcttatttaccagctaagaaaattctggcgcatggtgttatgccacctggcgactatgttctactatctgtcagcgacaatggtggaggcatttcagaggctgtgctaccctacatttttgaacccttctttacgacacgtgctcgcaacggtggaacgggtctcggcctcgcttctgtgcatggtcatatcagcgcgtttgcaggttacatcgacgttagttcaactgttgggcatgggacgcgctttgacatttatctccctccgtcttctaaggagcccgtcaatcccgacagctttttcggccgcaataaggcaccgcgtggaaacggggagattgtggcacttgttgagcccgatgacctcctgcgggaggcgtatgaagacaagatcgccgctctgggatatgagccggtcggttttcgtacctttagtgaaattcgcgattggatttcaaaaggcaatgaagccgatctggtcatggtcgaccaagcgtctcttcctgaagatcaaagtcctaattccgtggatttagtgctcaagaccgcctccatcatcattggcggaaatgatctcaaaatgcccctttcaagggagaatgcgaccagggacctttatctgccgaagccgatatcgtccagaactatggcgcatgcaatcctaaccaaaatcaagacgtagagttgcgacgtatcaggactgggcaatcgcggccgccgggcttacgtgtcttttgtaacaaattgcgacgcagttgatatccacttgaaacattagtccgaaattatcgagatctccgctgataaggtatcgaaatggcgataaaattggtattgatactcgtattcacactctttcccgcggcagacgctgcatatgcgaatgaccgcgccaacggtttcatgtggtcaaacgggggcgaaactggagtgaggcttcctcttcgggtgttcaatgccaagccagccaagaacacggtggcgatcatttattccggagacgctggatggcaaaatatcgatgaggcgattggtacctatctgcagacggaagggattcctgtcattggcgtcagttcacttcggtatttctggtcggagcggtccccaagcgaaactgctaaggatcttggtcacataatcgatgtctacaccaagcatttcggtgtgcagaatgttttacttgtaggatattctttcggcgcggacgtcatgccggcaagcttcaataggcttacgcttgagcaaaaaaatcgggttaagcaaatctctctcttggcattgtcacatcaagtcgactatgtcgtctcatttaggggctggctccaactcgaaacggaaggtaagggcggcaatcctctggatgatctcagatccattgaccctgcaatcgtccaatgcatgtacgggcgcgaagaccgtaataatgcttgcccatctctccgacagaccggcgcagaggtgataggcttcagcggaggccatcactttgataatgatttcaaaaaactgtctacgcgcgtcgtctcaggcctcgtggcacgcctaagtcatcagtaatctttagttcctgcaccgcgggacccgcgaggtttctcgcttcaattgaaatcataaagaagcaattgaaaattttcgagtaaccgaccctcccgataatcttcaacataaaacaacgcacttcttccaacgggagaggcggtgttagttgcgagctaaggagataaggtatgcttaagagatcggggtcgctttctcttgccttgatggtctccttctgttcgtcgagccttgccacgccactctcatctgctgagtttgaccatgttgctcgcaagtgtgccccatcagttgcgacatctacgcttgcggcgatagctaaggtggagagtcgctttgatcctttagcgattcatgacaacacgaccggcgaaacgcttcactggcaagatcacagccaagcaacccaagtcgtcaggcaccgtctcgatgcacggcattcgctggatgttggcctcatgcaaataaactctcgaaatttttctatgctcggtctgacacctgacggtgcgctccaggcgtgcacatcattatctgccgctgcaaacatgctgaaaagtcgttatgcaggcggcgaaacgattgacgagaagcaatttgcgcttcgtcgggcgatctccgcttacaacaccggtaatttcatcggcggttttgcaaacggctacgtgcgaaaagttgaaacagctgctcaatcgctggtgcccgcgttaatcgagcctccaaaagacgatcacgaggcgctaaaatccgaagagacgtgggatgtttgggggtcatatcagcgccgctcgcaggaggatggcgctggcggtttaatcgctccgccaccgccacaccaggacaacggcaaatccgcagacgacaatcaagtcttattcgacttatactaaggaggtgcgcattgatgcgatgctttgagagataccgtttacatctaaatcgcctctcgctctcgaatgcgatgatgcgcgtgatatcgagctgcgccccaagcttgtgcggtgcaattgcatggagcatttcctcatccggacccgccgcagcgcaatctgcgggtggcggcactgaccccgccacaatggttaacaatatatgcacgtttatccttggtccgttcggccagtcactcgctgttctcggcattgtcgctatcgggatctcctggatgttcgggcgggcttcgcttgggctggttgccggcgtcgtcggcggcattgttatcatgtttggggcgagcttcctcggccaaacgctcactggcggtagttgatggctgatcgtttggaagaatcgaccctttacctcgcagccacacggcccgcattgtttcttggggtgccactgacattggcagggttattcatgatgttcgccggctttgtcatcgttatcgttcagaacccgctctacgaagtcgttctcgtgccgttatggtttgcagcccggctcatcgtggagcgagactacaatgcggcgagcgtcgtcctgctatttttgcggaccgcgggaagaagcattgatagtgcagtttgggggggcgctactgttagcccaaatccaattagggttcccccacgagggagaggaatggtgtgatgctcggcgcgagtggaacgaccgaaagatccggtgagatctatctcccttatattggccacctcagcgaccatatcgtccttcttgaagacggatcgatcatgaccattgcgagaattgatggcgttgcattcgagcttgaggaaactgaaatgcgcaatgcgcgttgtcgtgcgttcaacacgctgttgcgcaatatcgctgatgatcatgtgtcaatatatgctcacctcgtacgtcatgccgacgtgccatcatcggcgccgcgacacttccgtagtgttttcgccgctagcctgaacgaagcttttgaacagcgcgtgctctccggccaactcctccgcaatgaacacttccttacgttgattgtctacccacaggcggctttagggaaggtaaagaggaggttcaccaagctaagcggaaaaagggaaaacgatctcacgggccagatcaggaacatggaagatctttggcatgttgtcgctggctctcttaaagcgtatggcctgcatcgtcttggcatccgcgagaagcagggtgtgctcttcaccgaaattggcgaagcgctacggttgatcatgactggtcggttcacaccggttccggtcgtcagcggctcactcggcgcttcgatttataccgacagagtcatttgcggcaagcgaggactcgagatcagaacgccaaaagacagttacgttggatccatctattcgtttcgcgaataccctgcaaaaacacggccgggcatgctcaacgcgctgctatccctcgattttccacttgttctcacgcagagtttttcgttcctgactcgcccgcaagcgcacgcgaaacttagcctcaaatcgagccagatgctgagttccggcgataaagccgtgactcaaatcggcaaattatccgaggctgaggacgcacttgcgagcaacgaattcgttatgggctcacatcatttgagcctttgcgtctatgcagacgatctcaatagtcttggggacaggggcgcgcgggctcggacacgaatggcggatgcaggtgccgtggttgtccaagaaggtattggtatggaagcggcctattggtcccaattgccggggaattttaagtggcgcacacgccctggcgcaatcacttcacgcaatttcgcagggtttgtctctttcgaaaactttccagagggcgccagctcaggccactggggcaacgcgattgcccgatttcgtaccaatggcggaacgcctttcgactatatcccgcatgagcacgatgttggcatgacggcaatattcgggcctatcgggaggggtaagacgacgctcatgatgtttgttctagccatgctcgaacagagcatggtcgaccgtgcaggtacggtcgtgttctttgacaaggaccggggtggcgaattgctggttcgcgccacaggaggaacatatttggcacttcacagaggcacacccagcgggttggcgccgttgcgtggcctagaaaacacagcagcctcacacgattttctgcgcgaatggatcgtggctctcatcgagagtgatggtcggggtgggatttctccggaagagaaccgccgtctggtccgtggtatccatcgtcagctctcgtttgatccacaaatgcgttcaatcgcggggttacgtgaatttttgttgcatgggcccgccgaaggcgcaggagcgcggctccaacgctggtgccggggccatgcgcttggctgggcatttgacggcgaagttgacgaagtaaagttagatccgtcgattaccggcttcgacatgacgcatcttctcgaatacgaggaagtatgcgctcccgctgcagcatatctcctgcatcggattggagccatgatcgacggccgccgttttgtgatgagctgcgatgagtttcgcgcctatttgttaaaccctaaattttcgactgtcgtcgacaaattcctcctgaccgttcgaaaaaacaacgggatgctaatactggcaacgcagcaaccagagcatgttctggaatcgccgctaggagccagcttggttgcgcaatgtatgacgaagattttctatccatcaccaaccgcagatcgatcggcttatgtcgatggactgaaatgtaccgaaaaggaatttcaggcgatccgtgaagacatgacggtcggcagccgtaagtttcttcttaaacgagaaagtggaagcgtcatctgcgaatttgatctgcgggatatgcgtgaatatgtcgccgtgctttcggggcgtgccaacacggtgcgctttgcaactcgactacgcgaggcacaagaaggcaactcatctggctggctcagcgaattcatggcccgtcaccacgaggcagaagattgataaggtaggaaacgatgaagacgacgcaacttattgcaacagttttgacctgcagctttctatatattcagcccgcgcgggcgcagtttgttgttagcgacccggcaacggaggctgagacgctcgcgactgcgctcgcgactgcggagaatctcactcagactatagcgatggttacgatgttgacgtcggcctacggcgttactggactactgacttcgctcaaccagaaaaatcagtatccttcgacgaaggacctagacaatgaaatgttttcgccgcgaatgccaatgtcgaccacggcacgtgcgatcaccagcgatacagatcgtgcagtcgtgggtagtgatgctgaagcggacctgttgcgatcgcagatcaccggttccgcaaacagcgctggcattgcggctgacaatctggaaacgatggacaaacgcttgacggcgaatgctgatacgtctgctcagctttcccgatctcgcaatatcatgcaggcaaccgtgaccaatggtttgcttctcaagcagatccatgacgcaatgattcaaaatgtacaggcgacaagcctattaacgatgactaccgcgcaggccggccttcacgaggcggaagaggcggccgctcaacgcaaggagcatcaaaagaccgctgtcatctttggtgccctcccctaaggctgggcgatttgttcatccgcccgcatcctcgccgaatgcgagctcattttatccaacattatgcgacaaaccagtcaagttcaggtccaatcgatgaatttcacgattccggcgccgtttacggccattcatacgatcttcgatgtagccttcacgacaggcttggactcgatgcttgagactatccaggaggcggtgagtgcgccattgatcgcctgtgtcactctttggattattgttcagggtattttagtcatacgcggcgaagtcgatacccgtagcggtatcactcgggtgatcacggtcaccatcgttgttgctctaattgttgggcaggctaactaccaagactatgtggtttccatcttcgaaaagacggtcccaaactttgttcagcagtttagtgtaaccggcttgcctctgcagactgttccggcacagttggatacaatgttcgccgtgacccaggccgtttttcagaaaatcgcatccgaaatcggtccgatgaacgaccaggacatccttgctttccaaggggcacagtgggtcctttacggcacgctctggtctgccttcggagtttacgacgccgttggaattctcacgaaagtgcttctcgcgatcgggcctctgatcctcgtcggatatatttttgatcgcacgcgggacatcgcagctaagtggatcgggcaacttatcacctacggtctcttgcttctcctcttaaacctcgtggcaacgatcgtcatcctaaccgaagcgactgcgctcacccttatgcttggtgtaatcaccttcgccggtacgaccgcggccaagatcattggtctttacgaactcgatatgttttttctgacaggggatgcgctcattgtcgctttgccggcgatcgccggcaacattggaggcagttactggagcggcgcaacccaatctgccagcagcttgtaccgtcgcttcgctcaggttgagcgaggctaggtcgcgcaaaaattcgcctcaatggagaattctatgaagtattgcctgctgtgcctagttgtcgctttgagcggctgccagacaaacgacacattagcgagctgcaaaggcccgatcttcccgctgaatgtggggcgatggcagcctactccgtcagatcttcagctcggcaattcgggtggacgctatgacggggcctgaatatgccatgctagtggcgcgcgaaagccttgccgagcactataaggaagtagaagcctttcaaaccgcgcgagcgaaatcggcgcgacgtctctccaaactcattgcagctgtcgcagctatcgcgattttgggaaatgttgctcaagcgttcgctatagccacaatggtgccgttgagcaggcttgtgcccgtatatctatggatacggccggacggcaccgttgacagcgaggtgtctgtctcgcgattgcctgcaactcaagaggaggccgtcgttaacgcctcattgtgggagtacgttcgcctgcgcgagagttatgatgccgacaccgctcagtacgcctacgacctggtatcgaacttcagtgccccaacagtgcgccaggattaccagcaattcttcaactatcccaatcccagttcgcctcaagtcattcttggcaaacgcggcagggtggaggtcgagcacatcgcttcaaatgatgtaactccaagcacgcagcaaattcgctataaaaggaccctcgtcgttgacggcaaaatgcctgtggtgagtacgtggaccgcgacagttcgctacgaaaaggtgaccagcttgcccggcagattgagactaaccaacccggcaggtctggttgtcacctcctatcagacatcggaagataccgtttcaaacgtaggccacagcgaaccatgatcagaaaagcacttttcattttagcatgtttatttgccgctgcgactggtgcggaggctgaagacactccaatggcgggcaagctagatccgcgcatgcgttatttggcttacaatcccgatcaagtggtgcgcctctcgacggcggttggagctactttggtcgtaacattcgccacgaacgaaacggtgacagcggttgccgtttcaaatagcaaagatctagcagccctaccgcggggaaattatctatttttcaaggcaagccaggtcctcacgcctcagccagtaatcgtgctaaccgcaagcgactccgggatgcgccgttatgttttcagtataagttccaagactctgtcccacctcgataaagagcagcccgatctctattacagcgtccaattcgcctaccccgccgacgatgcggcggctcggcgaagggaggcacaacagaaggctgttgtggacagactacacgcggaagcacaatatcaacggaaagctgagaatttattggatcagcctgtcacagcccttggtgcggcggacagtaattggcactacgtcgcccaaggcgatcgttcgctgttgccactcgaagtcttcgacaatggatttacgacggtattccactttccgggcaatgtacgcataccctccatctacaccatcaatcctgatggcaaggaagctgttgccaactattcagttaaagggagcgatgtcgagatttcttcggtttcccgaggttggcgtctgagggatggccacacagtactatgtatctggaacaccgcttacgatcccgttggccaaaggccgcaaacgggcacggtgaggcccgatgtgaaacgcgtcctgaagggggcgaagggatgaataacgatagtcagcaagcggcacatgaggttgatgcatctggatccctggtctccgacaaacatcgccggcgtctttcggggtctcagaaattgatcgtcggaggtgtcgttctcgcgttatcattaagcctcatttggctaggtgggcgccaaaagaaggtgaatgagaacgcatcgccgtcaactttgatcgcaacaaacaccaagccatttcatccagctccgattgaggtgccgccggatcctccagcggttcaagaggctgttcagcctgctgctcctctaccgccgaggggcgaaccggagcggcatgagccacggccggaagaaacaccgatttttgcatatagcagcggcgatcaaggggtcagcaaacgcgccattcagggcgacacgggccgaagacaagaaggcaagcgtgacgacaactccttgccgaatggcgaagtgtccggcgagaacgatttgtcgatacgtatgaaacccaccgagctgcagcccagcagcgccacgctcttgccgcaccccgattttatggtaacgcaagggacaataattccgtgcatcttgcaaaccgcaatcgacacaaatttggcaggctatgtaaagtgtgtcttgcctcaggatattcgtggaacaacgaacaatatcgtgcttcttgatcgtggcaccaccgttgttggcgaaatacagcgtggcttgcaacagggagatgggcgcgtttttgtgttgtgggatcgcgccgagacacctgaccatgcgatgatctcgttaacatcgccaagcgcggacgaactcggtcgctcaggattgccgggctcggtcgacagccacttctggcagcgttttagcggagctatgctcttgagtgttgttcaaggcgccttccaggcagctagcacctacgccggcagctcgggtggcgggatgagcttcaacagctttcaaaataacggtgagcagacaactgagacagcccttaaggcaaccatcaacataccgccaaccctgaagaagaatcagggtgacaccgtttccattttcgtagcacgggacctcgatttctttggtgtttaccagctccgcctgactggcggcgccacgcgggggaggaaccgccgctcttaatgaattcaaatttccgcttagagataggatacattgtaaatggaagtggatccgcaactacgctttcttctgaagccgattttggaatggctcgatgacccgaagactgaagaaattgcgatcaatcgacctggagaggcatttgtgcgccaagccggcatttttaccaagatgcctttgcccgtctcttatgatgatcttgaagatatcgctattttagcgggcgcgctgagaaagcaggatgtcggaccacgtaaccccctctgcgccactgaacttcctggtggtgaacgactacaaatctgtctgccgccgaccgttccctcgggcaccgtcagcttgaccattcgacggccaagctcgcgtgtttctggtcttaaagaagtctcctcccgttatgatgcttcgaggtggaaccagtggcagacacgaaggaaacgccaaaatcaggatgatgaagctatccttcagcattttgacaacggggatttggaagcgtttctgcacgcatgcgtcgtcagccgactgacgatgttgctatgtggccctaccggaagcggcaagacaacaatgagcaagaccttgatcagcgccatccccccccaggaaaggctaatcaccatagaagatacgctcgaactcgtcattccacacgataatcatgttagactactctactccaagaacggtgctgggctgggtgctgtgagcgccgagcacttgctccaagcaagtctgcgtatgcggccggaccggatattgcttggcgagatgcgcgacgatgcagcatgggcttatctgagtgaagtcgtctcgggacatccgggatcgatttcaacaatacacggcgcgaatccaatccaaggattcaagaaactgttttcccttgtcaaaagtagcgcccaaggtgctagcttggaagatcgcacactgattgacatgctctctacggcgatcgatgtcatcattccattccgtgcctatgaggacgtttatgaagtaggcgagatctggctcgcggcggacgcacgacgccggggcgagaccataggcgatctccttaatcaatagtagctgtaacctcgaagcgtttcacttgtaacaacgattgagaacttttgtcataaaattgaaatacttggttcgcattttcgtcatccgcggtcagccgcaattctgacgaactgcccatttagctggagatgattgtacatccttcacgtgaaaatttctcaagcgctgtgaacaagggttcagattttagattgagaggtgagccgttgaaacacgttcttcttatcgatgacgatgtcgctatgcggcatcttattatcgaataccttacgatccacgccttcaaagtgaccgcggtagccgacagcacccagttcactagagtactctcttccgcgacggtcgatgtcgtggttgttgatctaaatttaggtcgtgaagatgggcttgagatcgttcgaaatctggcggcaaagtctgatattccaatcataattatcagtggcgaccgccttgaggagacggataaagttgttgcactcgagctaggagcaagtgattttatcgctaagccgtttagtacgagagagtttcttgcacgcattcgggttgccttgcgcgtgcgccccaacgttgtccgctccaaagaccgacggtctttttgttttactgactggacacttaatctcaggcaacgtcgcttgatgtccgaagctggcggtgaggtgaaacttacggcaggtgagttcaatcttctcctcgcgtttttagagaaaccccgcgacgttctatcgcgcgagcaacttctcattgccagtcgagtacgcgacgaggaggtttacgacaggagtatagatgttctcattttgcggctgcgccgcaaacttgaggcggatccgtcaagccctcaactgataaaaacagcaagaggtgccggttatttctttgacgcggacgtgcaggtttcgcacggggggacgatggcagcctgagccaattgcatttgattaatttaggtgactgaggacgcggccagcggcctcaaacctacactcaatatttggtgaggggttccgataggtccctcttcaccaattgctcgatggcttctctccagcaaagaatgacgcgagcgcggcggtagccagcttgtggccgaaagctcgagcggtctccaaccccaacggatcaaaatgacttcgagcgacctcgagcaacgcaaccgggaacatgcgtgaggtctgaacgagaacggatttttctgtagttgaagggatcggataacttttcggggccacgcgaaatgatccatctgccagcatgctttcgaaatcgtccaacgcgcgccttaaaatcatttgtagcgacttcgagggactgtattgccgaacgaggttgtcatatgttttcgacacttgaggcgcgggcggtcgcgctgaaagaaaaacctggagctttttcggggacggaggtggactaagggcatccacagttagcttaagttgtcgatcgggactgtaaatgtgatcggcgacgagaggctcacgttgctggtctttctcgtcggctttttcaggcaagtgctggaggtccagcttctggggaacaagtgtcgggttgggatggtggatctcgggtcgagcaccagcaagccgccgtgcttcgccgaccgacaatgcgggcttgcgaattgccatcttcaagcctccaagattttgctgatcagtttcgaaatgaccacgacttcctccatcgcaatccgaagattcctctctatgaggcgcatcgtcggatcagttcccgtgtttagtaatgtaagatgcaacatgccgcgttctttcatcgcggcaaatgcatctctttcatgcatgggagacggtacaactggaaggctctctagcgtctctgacatcctgcgttgcgatgttgtcaatcggccgaccgggacgcgttggcgcaaaacagctgtaggaattgccaaattttcactcaacagcagctcgatgacgtagcggtaggtagatagtgcctcatcgatgtcgagcggcgttagcatggtggggatcagaagcaggtttgagctagcgatgattgtgttgttgagctcgctcgagccgccacgcgtatcggccaacgcataatcaaatccttcgagctcggcattttcataggctgcttcaagaaggggcatttcgtcggcggaatagacttcacagcgaggatcccaggtactgctttgtaaggcgttttctctccatcgcgtcagaggccggttttcgtcggcatcaaagagggccactcgtttaccgtcatttgccaaagcagcgcaaaggcccatgagtgcggtggttttgccagcaccccctttgaaagaacaaaacgtcaaaagttgcatattctgatcccgcctatcctgtgaaaccggagtgcatttgtatttttgttcgtataaatgtttttgtgattatcgatgagtaaaagcgttgttacactatttttatttcacattcgttataagacaattgcaaatgtagcaagtatattcagtattgactgtaaatgtactgttgatttcatattgagcagggctagacttccatccgtctacccgggcacatttcgtgctggagtatccagaccttccgctttctttggaggaagctatgtcaaaacacaccagagccacgtcgagtgagactaccatcaaccagcatcgatccctgaaagttgaagggttcaaggtcgtgagtgcccgtctgcgatcggccgagtatgaaaccttttcctatcaagcgcgcctgctgggactttcggatagtatggcaattcgcgttgcggtgcgccgcatcgggggctttctcgaaatagatgcagacacacgagaaaagatggaagccatacttcagtccatcggaatactctcaagcaatgtatccatgcttctatctgcctacgccgaagaccctcgatcggatctggaggctgtgcgagatgaacgtattgcttttggcgaggctttcgccgccctcgatggactactgcgctccattttgtccgtatcccggcgacggatcgacggtcgctcgttactgaaaggtgccttgtagcacttgaccacgcacctgacgggagaaaattggatgcccgatcgcgctcaagtaatcattcgcattgtgccaggaggtggaaccaagacccttcagcagataatcaatcagctggagtacctgtcccgaaagggaaagctggaactgcagcgttcagcccggcatctcgatattcccgttccgccggatcaaatccgtgagcttgcccaaagctgggttacggaggccgggatttatgacgaaagtcagtcagacgatgacaggcaacaagacttaacaacacacattattgtaagcttccccgcaggtaccgaccaaaccgcagcttatgaagcaagccgggaatgggcagccgagatgtttgggtcaggatacgggggtggccgctataactatctgacagcctaccacgtcgaccgcgatcatccacatttacatgtcgtggtcaatcgtcgggaacttctggggcaggggtggctgaaaatatccaggcgccatccccagctgaattatgacggcttacggaaaaagatggcagagatttcacttcgtcacggcatagtcctggatgcgacttcgcgagcagaaaggggaatagcagagcgaccaatcacatatgctgaatatcgacgccttgagcggatgcaggctcaaaagattcaattcgaagatacagattttgatgagacctcgcctgaggaagatcgtcgggacctcagtcaatcgttcgatccatttcgatcggacgcatctgccggcgaaccggaccgtgcaacccgacatgacaaacaaccgcttgaaccgcacgcccgtttccaggagcccgccggctccagcatcaaagccgacgcacggatccgcgtaccattggagagcgagcggggtgcccaaccatccgcgtccaaaatccctgtaactgggcatttcgggattgagacttcgtatgtcgctgaagccagcgtgcccaaacaaagcggcaattccgatacttctcgcccggtgactgacgttgccatgcacacagtcgagcgccagcagcgatcaaaacgacgtcatgacgaggaggcaggtccgagcggagcaaaccgtaaaagattgaaggccgcgcaagttgattccgaggcaaatgtcggtgagcccgacggtcgcgatgacagcaacaaggcggctgatccggtgtctgcttccatccgtaccgagcaaccggaagcttctccaacgtgtccgcgtgaccgtcacgatggagaattgggagaacgcaaacgtgcaagaggtaatcgtcgcgacgatgggcgcggggggacctagactagtagacaggaaggaccgaataatggcaaatggtcagttcacgatacgctctgctcgcccggcctccgtcggactgacaggcgaacggcgtggagccgcatccgcctctagctctgcactgtccaatgttcaaagagatgttagggataggctgattccaactagctcaccaagattaccaaatgcagccatattgcgtgattcctcgggaagagcgtcgactggtctgcggtacatggcggctactcttcattggtctgcgatcgcgccattatcgctaataaacagcaacgacctggctccggccgcttatgactttgagacgcgaaataacgcaagaaatgtgactgccaaagtcggcagggcagtccctgttcccaagcaaggcgggctcggcaaaacgctcgcacccgtaccccttagtacacgtatatcaagggtcaattccgaccgaagactgcccgctgacgcagaagaccgccctgaaacgcgcgacccccagaaaggacgtggcagtcatggtgcgacgccaaccttacatgaaaagattggaaccgcgtttgctcgaagattgcgaaagcatacgtactatattgtttgcagttgctgccagacccggagcgcgttgacgatgggtgcaaagatttcggtgaagtcatgaactccagcaagacttcgccccagcgtatgaccctgagcatcgtatgttcgctggcagccggtttttgtgcggccagctgctatgtaacgttccgccggggcttcaacggcgaagcgatgatgacgttcgacgttttcgctttttggtatgagaccccgctttacttgggttatgccagcaccgtcttctggcgtggtttatctgttgtcatctttacctcgctgatcgttctttcaagtcagctcatcatatcgctgcgcaatcagaagcatcatgggacagctcgttgggcagaaattggcgaaatgcggcatgctggttatctgcagcgttacagtcgcatcaaggggccgatctttggaaagacatgtggtcccctttggttcggcagttatttgaccaatggcgaacagccacacagtcttgtcgtcgcgccaacgcgtgctggcaaaggcgtcggcatcgtcattccaacgctgttgaccttcaagggctcggtaatcgcccttgacgtcaagggagaattgtttgaactgacgtccagagcacgcaaagcgagcggcgacgcagttttcaagttctcccccctagatcctgagcggaagactcattgttacaatccggtcctggatattgccgcacttccgcccgaacgccagttcactgaaacacgccgtctagctgcgaaccttattacggctaagggaaagggagcagaaggctttattgacggcgcacgtgacctgttcgtcgcgggaatccttacctgcattgagcgtggcacaccaacgattggcgcggtatatgacctatttgcgcagcctggcgaaaagtataagctttttgcgcaactcgcggaggaaagcctaaacaaagaggctcagcgtatcttcgataatatggcgggcaacgacacgaaaattctgacatcgtacacctctgtgctgggcgacggtggactgaacctgtgggctgatccgcttatcaaagcagcgacaagccggtcagacttttccgtttacgatctccggaggaagaagacctgcatttatctttgtgtcagtcccaacgatctggaggtcttggcaccacttatgcgcctgatgtttcagcagctcgtgtcaatcttgcagagatcgctgccaggtgaagacgagtgccatgaagttttatttctcctcgacgaattcaaacacctgggcaagcttgaggccatagagaccgcgatcacaaccatcgccggttacagaggccgctttatgtttattattcaaagtctttcggccttgtcgggcacatacgatgacgcaggaaaacaaaactttctgagcaatactggcgtacaagtatttatggccacggctgatgacgaaactccaacctacatctcaaaagctatcggcgaatatacgtttaaagcgcgttcgacctcttacagtcaagccagaatgttcgaccacaacatccagatttctgatcaaggtgcagcccttttgcgccccgaacaagtgcgcctgctagacgatcagagtgaaatcgttctcatcaaagggcgacctccactcaaattacgaaaggtgcagtattattccgatcgtacgctgaaaggccttttcgaacgccagatgggctctctgcctgagcccgcacccttgatgctttccgactatagcaacgatcaagttcaataccacttggctccgatagcaaattttaatgaggatgctgcaccgcaaaacagaactgtggccgaggaccatggaagtgttaaagtcggtgctgatatccctgaacgcgtgatgggaataaatggtgacgaggaacaagccgatgcgggcgagataccgccggaatcggttgtgcctccagaattgacgctcgctctgaccgctcaacagcaattgttggaccagattattgcacttcagcaaagatcgaggtccgcaccggcatagcctgcgaaatgatcttaatggtgcaattcgtttcaggcggcatgttgcggttcaacaaagtgtacgccagatcccaattggccctttacgaggtgtcggtatgacaggaaagtcgaaagttcacataagaggttcggctgacgcgcttcctgacgttcctggcggaagtactaccgccccttttttaaccgaaccttctcgggatcaggttgatgcctcgtttgaggtccaaaccgactacagccagtctacttccgtgtcgtttacctatgatggtgttggacttggtcctgccgagcgtgcggcttacgagaactggtgcgaaccgggccggcccacttggaaagatcttataatcaaggcacgtgtcgatccgattgacgatgtgacctggctccgagatttagaagaggacaccccctcaaccttcagatacgaagggatgcctctgggcatcggggaacgacaggcctacgaaaattggcaagaggacgctcagccgacatgggaagaccttgttgtcagcgcacgcttgacggaacttggccgtccacacgggattaccggcgagtatacatccctcgcaggatcgaagaatacaagttcaatttcattgaagcgaaagcggagcaacttaattgatgatgagaattcatccggatcgttttcatatgacgggatgaagctcggggaagccgagcgttctgcatatggtgactgggccgaggcggagccacccacgtggaaagatttggtattgagggcacgcgtttcctcgatcaatgactctgcttggctttttgattcacaaacatcttcatcatcatttgaatacaacggtgttcccttgggcgagccggaacggcaggctctcagacaatggcaaggagacgctcagcctacctgggaagatctcgttgttaacgcgcgtatggcagaactttgccatgctggttggattgaaggtcaaaaaggttgctttgaagagcgcggggaggctctgcccgcgtcggaacgcggttcgcaacgccccattggtcaacggacagattcctccgattcttttgtgtatgatggcacaaggctcggagcacctgagcgaactgcttatgaacgctggagtaagagggaacgcccgacttgggaagatctcatcttagatgcacaccaggccaggactgaaagtgacgctgttacgacccaagcgattggtcagtcgtcctcaccggttttcttatatgaaggaaagtcgctcggagacagggaacgaaaggcttacgaaaaatggcggcagccagcccaaccgcgatggcaaaatcttgtagtgaacgctcgtctggcagaaatcgatccctcagcctggattgccgatgagcgcgatccgcttgatgatagcgacgcgcttggtcgcccgtcgtacacaagcttgacggatagatcagacgtccctttagacgatcaatcaatctatcgtcgttccgacctagtaagggagcaggtgccagaatcgtctcaaaggcaattcgcagcatgttcagaatctgaaacgaggcctgtgcaatggtttactgcttctgggtcagatgcaaacaatacggaaaatatcaccgccagcgatcccgtcgatcgcacgggtggagttaagcggctaggctccaaaagcgacagaaccgttacagcttctatccatgacgtgaattccagcacaaggcgactgttgcttaacgaatttggatcggaggctccgcgcccttcgccagaaaagactgttcgcttaagaagcgacaatattggcacctatgggagccggaaaaatgaacgagcgcggctcgcgaccgaaaccggtgcgtatgagtcggagcatattttcgggttcaaggctgtccacgatactgcgagagcgacgaaagagggccggcgtctcgaaaggcccatgcccgcctaccttgaggataaggggcttcatcgccaacatattggcaccgggagaggacggaccaaacttgtcgggcgcggatggccggatgacacaagctatcgctcggatcaaagggcaactctgtcggaccccgttgcgcgctcggaaggcgcgacggcctcaaatgggtatcaattgaaccaattgggttacgcgcaccaactcgctagcgatggcctgcaaagtgaatcgcccgatggtgttgccttgccaattcaagtggcaacaacgagctacaactatacagtgagccgcgatcctgtccttgttccgccggataaaaacgaagcccctcaattgctgcatcttggtccccgtggtcaaaccgaagctgttcttgcccgcgaaacagcattgactggaaaatggccgactctcgagcgtgagcagcaagtgtatcgcgagtttttggccttatatgacgtaaaaaaagatcttgaggccaaatcagtcggcgtaagacggaaaaaaaaagaagttatttctgcgttagaccgaactgcgcgcttgataagcacgtcgccttcgaaagctcgatccaaagcagagactgaaaaagccattgatgagctcgatgatcgacgagtttatgatccgcgtgatcgagctcaagacaaagcgtttaaacgctgataagtcgccaatatagtgatcatttgcagtattcgcatcgatcgctggttgatattctgccgctggtcgaccggctgctcgtcgccaaaaatgctcacagggatacgatggcctcggtcaggccgcgtgcgtcctgtctttccagttcctccctttcagctcgattgtggcatcatttattgcctgctcattgcagttgaaacgcgatatccgtttcaagacccgggtatggatggtactttggagatatgagcacttgccagacttcccggtcggagacttaaaaattccgataagaggttacggacgacggaccttataagtggatcgtctagtggtggcgccgatcaaaacagttccgcccccggctttgctcaaagtagcaaagcagctttatctcgggttgcggaggattttctagaaaaccgcaattttgcaggagagaacatatggccatcatcaagccgcatgtgaacaaaaataggacaacctcgccgatagagagaccggagtctctcatagaggaaatgagcggcagtcatccgccgagtggttttaccaacctggatctcgctatgatcgagctggaggactttgtccatcggtgcccgctcccagaagacaatcttgctggtcagaaggagtgagacgatggatccgtctagcaatgagaatgtctatgtgggtcgcggtcacaacatcgaaaatgatgatgacactgaccccaggcgttggaagaaggcgaatatcagttccaacaccatctccgatattcagatgacgaatggcgaagacgtacaatcagggagccctacccgaacggaagttgtaagcccacgtctggattatggatcggtcgactcctcctccagcctttattctggcagcgagcacggaaatcaagctgagattcaaaaagagctgtccgtcttgttctcgaacatgtctttgccaggcaacgatcggcgcccggacgaatacattctcgtgcatcaaacgggacaagatgcttttactggtattgccaaaggcaacctcgaccaaatgcccaccaaggcggaatttaacgcgtgctgccgtctctacagggacggagccggtaattactacccgccacctctcgcattcgacaagattagcgttccagagcaactggaggaaaaatgggggatgatggaggcgaaggaacgtaacaaactgcggtttcagtacaagttggacgtatggaatcatgcgcacgctgatatggggatcacgggcacagagatcttttatcaaacagataagaacataaagctcgaccggaattataaactaagacctgaagaccgatacgtacaaacagaaaaatacgggcgccgggaaattcaaaagcgatatcaacacgaactccaggctggttcgctgctgcccgatattatgatcaaaactccccaaaatgacatccacttcgtgtacaggtttgccggcgacaattacgccaacaaacagttcagcgagtttgaacacaccgtcaagcgcaggtatggcgacgagactgagatcaaattgaagtcaaagtcaggcattatgcatgactcgaaatatctggaatcctgggaacggggcagtgcggatattcgcttcgcggaattcgttggggaaaatagagctcacaatcggcagtttccaactgcgacagtaaatatgggacagcagccagacgggcagggcggtttgacccgcgaccgtcatgtgagcgttgacttcctaatgcaaagcgcacccaattcgccttgggcgcaagctttgaaaaagggagaactgtgggatcgcgttcagttgcttgctcgcgacggcaaccgctatctgtcgccgcccagattggaatattctgaccctgcacatttcaccgagttgatgaaccgggttggtttacccgcatcgatgggtcggcaaagccatgcggctagtatcaaattcgaaaagtttgacgcgcaggcagcggttattgtcttaaatggcccagagttacgtgacattcatgacttgtctcctgaaaaactgcaaaatttgtccaccaaagatgtcatcgtcgccgatcgcaatgagaatggtcagagaactggcacgtacaccagcgtcgcggaatatgagcgcttgcagttaaggctgccacccgatgcagcgggggtgcttggtgaagcaactgacaaatattcacgtgatttcgttcggccagagccggcgtcgcgtccaatcagtgacagccgcaggatatacgaaagtcgaccgcgtagccaaagcgtcaacagcttttgacgttcctgctgccgcgtcaacgaggaagctcgtttgacccgggtttgccaatgaaagggctcaatcatggtgaacactacaaagaaaagttttgcgaagtcgcttacggcagatatgcgccgttctgctcagcgcgttgtcgagcaaatgcgaaaagcattgattaccgaagaagaggcgctcaagcggcaagccagactggagagtcccgataggaagcgaaagtatgctgctgatatggcgatagtcgacaaactcgacgtagggtttcgaggcgaaataggctataaaattcttggaaataaccggcttcgagtagacaaccataaagaattaacgcgtgagcacggtagacttcgcaaaaccaaaacggttctgaagcgtaacccggtgacgcaggaagtctatttgggtttatatgaaaggaagtcctggttaagtgtcagcagccatttgtatgctgcggacggcacactccgcatgaagcacgtgaaatacaaagacggacgttttgaggaaaaatgggagcgcgacgaaaatggcgacctgatccgcacaaggtacgccaaccgtggcaggctctttcaacctgtatccgagaaaatgggcgcgccgtatcggagcggccctgacgaccggctctatcgcgatctaacccgtcgaaacggtttcagacgggagacattcgaacgggacgatcacggaaacctcgagcgtatcggcagcaaccatgtcggcttttccaagatttcagtgaaggcacccaatcgtcaaacctcccagacgaagattcaaaaacttggtggcgctttcaacaaatcttttaggtcccttctggacaaggagggcaatgaaatgggccgcgatattttgagccatcgacggctctataacaagcggtctgctgtctacgatgaagctaccggacaattgaagagtgccaagcataccttcggcaagatctacaggagcgaaaccgaatatctcagcgcgggcctcaagaaggtttcaaaaaagatactcggggtgacggtctaccggaaatttgcggcgctcagcgagcgagaatccgaggctgagagactgcgtagttttgaatccggtgcgcatcgccagatctggcaggagcgggcagcgattcccggttcgcccctcccggagactgatgacattcatttcgcacagcagtcgcacctagccaaagccaaccctgatcacgtcgaagctgacgtcacgcgtgtgacagatcaacatgttgatgttgctggacaaacatcatcgtctccccaacggaacttggaaggatggttagattctcaatcacgatacaagccagcaaacatgctgttgtcaaatccagaccttcaagcgaacggacctcgcccatacgaagggttagctcatctcaccctccggcgcgataatgaatctgacgggcacaaggagaatgatcagcggctgcgacatttctcccagccagagccgttggtgttaccgcatcccgggtcgccggaaataactaaggtgtttggctcgcggggagagccggcacacccgagtggaaatctgcacacggcggttggagaaacggcttgcgaaggaccggtgatgtcttcatcctcggacaatcatcagccagctccaggacagcaagaacttttaagtttccttcataatgcgccagccccagtttctgtggcaatacatgatgatcaagagcgacttgcgggggaggcgcccggcggctctttcagaggtagctcagggcgaacgagttcaatgtcggagagtatcttcgacgaagatgtacaagggcatttggtacgggattattcgatcaatactactaacgggtttattgacccgcaatcgttgttcggtgaaccggacttatcgagaggtccaaaatcggggccagaaattccatcggaagattaccatttgtcagcttcggaacaggaaaatttgctgaatcaattgcttagtgtgccactgccggttccttcaccgaagcccgaatgcgcgaggtctatgattttcgaaggttcacgttcaagagagcgttccacctccagagggttctaaggtggaacgcgtctaggcttgcctatcatcaccacctcatgatggtcgcggagaccttcgaagagatatccgacatcattggagaagctgggccggaaactagtgtacctcgcgaatgcatctagatccaatccaatatgcatggcatgccgaatccatgtgggagtttattcttgacacagatatttatgatataataactgagtaagcttaacataaggaggaaaaacatatgttacgcagcagcaacgatgttacgcagcagggcagtcgccctaaaacaaagttaggtggctcaagtatgggcatcattcgcacatgtaggctcggccctgaccaagtcaaatccatgcgggctgctcttgatcttttcggtcgtgagttcggagacgtagccacctactcccaacatcagccggactccgattacctcgggaacttgctccgtagtaagacattcatcgcgcttgctgccttcgaccaagaagcggttgttggcgctctcgcggcttacgttctgcccaagtttgagcagccgcgtagtgagatctatatctatgatctcgcagtctccggcgagcaccggaggcagggcattgccaccgcgctcatcaatctcctcaagcatgaggccaacgcgcttggtgcttatgtgatctacgtgcaagcagattacggtgacgatcccgcagtggctctctatacaaagttgggcatacgggaagaagtgatgcactttgatatcgacccaagtaccgccacctaataatgtctaacaattcgttcaagccgacgccgcttcgcggcgcggcttaactcaagcgttagatgcactatacgtaccaatccaaatcggatccccctgcagggctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagcagatctatcgatggtacctatctgcagacggaagggattcctgttaattaaaacagcttgcgtcatgcggtcgctgcgtatatgatgcgatgagtaaataaacaaatacgcaaggggaacgcatgaaggttatcgctgtacttaaccagaaaggcgggtcaggcaagacgaccatcgcaacccatctagcccgcgccctgcaactcgccggggccgatgttctgttagtcgattccgatccccagggcagtgcccgcgattgggcggccgtgcgggaagatcaaccgctaaccgttgtcggcatcgaccgcccgacgattgaccgcgacgtgaaggccatcggccggcgcgacttcgtagtgatcgacggagcgccccaggcggcggacttggctgtgtccgcgatcaaggcagccgacttcgtgctgattccggtgcagccaagcccttacgacatatgggccaccgccgacctggtggagctggttaagcagcgcattgaggtcacggatggaaggctacaagcggcctttgtcgtgtcgcgggcgatcaaaggcacgcgcatcggcggtgaggttgccgaggcgctggccgggtacgagctgcccattcttgagtcccgtatcacgcagcgcgtgagctacccaggcactgccgccgccggcacaaccgttcttgaatcagaacccgagggcgacgctgcccgcgaggtccaggcgctggccgctgaaattaaatcaaaactcatttgagttaatgaggtaaagagaaaatgagcaaaagcacaaacacgctaagtgccggccgtccgagcgcacgcagcagcaaggctgcaacgttggccagcctcgcagacacgccagccatgaagcgggtcaactttcagttgccggcggaggatcacaccaagctgaagatgtacgcggtacgccaaggcaagaccattaccgagctgctatctgaatacatcgcgcagctaccagagtaaatgagcaaatgaataaatgagtagatgaattttagcggctaaaggaggcggcatggaaaatcaagaacaaccaggcaccgacgccgtggaatgccccatgtgtggaggaacgggcggttggccaggcgtaagcggctgggttgcctgccggccctgcaatggcactggaacccccaagcccgaggaatcggcgtgagcggtcgcaaaccatccggcccggtacaaatcggcgcggcgctgggtgatgacctggtggagaagttgaaggcagcgcaggccgcccagcggcaacgcatcgaggcagaagcacgccccggtgaatcgtggcaagcagccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggcaggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctagctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagccgaagagctgcaaaaagcgcctacccttcggtcgctgcgctccctacgccccgccgcttcgcgtcggcctat

SEQ ID NO: 110 - DNA, 37819 bp, Artificial sequence
  Synthetic construct
ttatacaaagttgatagattgtatgaattcatttacaattgaatatatcctgccattttacacctcgatatatcctgccacaaattccatgtacacagtacattaaaaacgtccgcaatgtgttattaagttgtctaagcgtcaatttgtttacaccacaatatatcctgccaccagccagccaacagctccccgaccggcagctcggcacaaaatcaccactcgatacaggcagcccatcagtccactagagggcccgccgagaatgaacgccaagaggaacaagcatgaaaccgcaccaggacggccaggacgaaccgtttttcattaccgaagagatcgaggcggagatgatcgcggccgggtacgtgttcgagccgcccgcgcacgtctcaaccgtgcggctgcatgaaatcctaggaaatatcagccgcttgtgtgttcaattcttctctgtttcacttgaaacaaattgaatagatattcccgctttcaaagccatttacaaatcctctcgtgcagcctaacgccattggcgtggaacaagcgttggcacgaggaagtaagtgcgatgaacggaaggtattcaccgacgcggcaggattttaagacaggcgcgaagccttggtctatattagcccttatcgttgccgcaatgattttcgcgttcatggcggttgcgtcctggcaggacaatgggactacccaggcaatccttagccaaatacgatcgattaacgctgacagcgcctcactgcagcgcgatgtactccgcgctcacacgggcaccgtggcgaactaccgccccattatctccaggctgggagctctgcggaagaatctggaagatttgaagcaattatttaggcaatctcatattgtaagtgagagcaatgctgctcaactgctacgccggctagaagtgtctctaaattcggctgacgcggcggtcgccgcctttggtgcgcaaaatgtccgcctgcaagattcgctggccagtttcactcgtgctttaagcaatcttccaggaaaggcctcaggcgatcagactttagaaaaaccaacagaattggctagcatgatgctccaatttcttcggcaaccaagcccggctatttcattcgagatcagccttgaactagagaggctccaaaaacaacgcggtcttgatgaagctcccgtgcgcatactttcgcgtgaaggtcccattatcttatcgcttttgccacaggtgaacgatctggtgaacatgattcagacgtctgacaccgcagaaattgcggaaatgttgcagcgtgagtgtttggaggtctatagcttgaaaaatgtggaggagcggagcgcacgtatctttcttgggtccgcttcagtgggtctttgcctgtacatcatcaccttagtctataggctacgcaaaaaaaccgattggttagcgcggcgtttagattacgaagagctaatcaaagagatcggagtatgttttgaaggtgaggcggccactacgtcgtccgcgcaagctgcacttggtattattcagcgcttctttgatgccgatacgtgcgcgttagctctagtggaccatgaccgtaggtgggctgtcgaaacattcggtgcgaagcacccaaaacccgtgtgggacgacagggtgctacgcgaaatagtctctcgtaccaaagcgaacgaacgggcgacggtattccgcatcgtatcgacgcaaaaaatcgtacatttgcctcccgaaattccaggtctttcgatactactggctcacaaatccacagataaactaattgcggtttgttcactgggttaccaaagctatcgccctcgaccttgccaaggcgaaattcagcttcttgaactcgccaccgcctgcctctgtcactatatcgatgttcggcgtaagcagaccgaatgcgacgttttggccagacgattggagcatgcgcaacgccttgaggcagttggtacacttgccggcggaatagcacatgaatttaataacattttggggtcaatcctcgggcacgcagaattggcccaaaactcggtgtctcgaacatctgtcacccgaagatacattgactatatcatttcgtcaggcgacagagccatgctcattatcgatcagatcttgacgctgagccgaaaacaagagcgcgtgatcaagccatttagtgtctcagagcttgtgaccgaaatcgctcccttgctacgtatggctcttcccccaaccatcgagcttagtttcagatttgatcaaatgcagagcgtgatcgaaggaagcccgcttgaacttcaacaggtactaattaacctctgcaagaatgcttcccaagccatgactgcaaatggtcaaatcgacatcttcgtcggccaagcttatttaccagctaagaaaattctggcgcatggtgttatgccacctggcgactatgttctactatctgtcagcgacaatggtggaggcatttcagaggctgtgctaccctacatttttgaacccttctttacgacacgtgctcgcaacggtggaacgggtctcggcctcgcttctgtgcatggtcatatcagcgcgtttgcaggttacatcgacgttagttcaactgttgggcatgggacgcgctttgacatttatctccctccgtcttctaaggagcccgtcaatcccgacagctttttcggccgcaataaggcaccgcgtggaaacggggagattgtggcacttgttgagcccgatgacctcctgcgggaggcgtatgaagacaagatcgccgctctgggatatgagccggtcggttttcgtacctttagtgaaattcgcgattggatttcaaaaggcaatgaagccgatctggtcatggtcgaccaagcgtctcttcctgaagatcaaagtcctaattccgtggatttagtgctcaagaccgcctccatcatcattggcggaaatgatctcaaaatgcccctttcaagggagaatgcgaccagggacctttatctgccgaagccgatatcgtccagaactatggcgcatgcaatcctaaccaaaatcaagacgtagagttgcgacgtatcaggactgggcaatcgcggccgccgggcttacgtgtcttttgtaacaaattgcgacgcagttgatatccacttgaaacattagtccgaaattatcgagatctccgctgataaggtatcgaaatggcgataaaattggtattgatactcgtattcacactctttcccgcggcagacgctgcatatgcgaatgaccgcgccaacggtttcatgtggtcaaacgggggcgaaactggagtgaggcttcctcttcgggtgttcaatgccaagccagccaagaacacggtggcgatcatttattccggagacgctggatggcaaaatatcgatgaggcgattggtacctatctgcagacggaagggattcctgtcattggcgtcagttcacttcggtatttctggtcggagcggtccccaagcgaaactgctaaggatcttggtcacataatcgatgtctacaccaagcatttcggtgtgcagaatgttttacttgtaggatattctttcggcgcggacgtcatgccggcaagcttcaataggcttacgcttgagcaaaaaaatcgggttaagcaaatctctctcttggcattgtcacatcaagtcgactatgtcgtctcatttaggggctggctccaactcgaaacggaaggtaagggcggcaatcctctggatgatctcagatccattgaccctgcaatcgtccaatgcatgtacgggcgcgaagaccgtaataatgcttgcccatctctccgacagaccggcgcagaggtgataggcttcagcggaggccatcactttgataatgatttcaaaaaactgtctacgcgcgtcgtctcaggcctcgtggcacgcctaagtcatcagtaatctttagttcctgcaccgcgggacccgcgaggtttctcgcttcaattgaaatcataaagaagcaattgaaaattttcgagtaaccgaccctcccgataatcttcaacataaaacaacgcacttcttccaacgggagaggcggtgttagttgcgagctaaggagataaggtatgcttaagagatcggggtcgctttctcttgccttgatggtctccttctgttcgtcgagccttgccacgccactctcatctgctgagtttgaccatgttgctcgcaagtgtgccccatcagttgcgacatctacgcttgcggcgatagctaaggtggagagtcgctttgatcctttagcgattcatgacaacacgaccggcgaaacgcttcactggcaagatcacagccaagcaacccaagtcgtcaggcaccgtctcgatgcacggcattcgctggatgttggcctcatgcaaataaactctcgaaatttttctatgctcggtctgacacctgacggtgcgctccaggcgtgcacatcattatctgccgctgcaaacatgctgaaaagtcgttatgcaggcggcgaaacgattgacgagaagcaatttgcgcttcgtcgggcgatctccgcttacaacaccggtaatttcatcggcggttttgcaaacggctacgtgcgaaaagttgaaacagctgctcaatcgctggtgcccgcgttaatcgagcctccaaaagacgatcacgaggcgctaaaatccgaagagacgtgggatgtttgggggtcatatcagcgccgctcgcaggaggatggcgctggcggtttaatcgctccgccaccgccacaccaggacaacggcaaatccgcagacgacaatcaagtcttattcgacttatactaaggaggtgcgcattgatgcgatgctttgagagataccgtttacatctaaatcgcctctcgctctcgaatgcgatgatgcgcgtgatatcgagctgcgccccaagcttgtgcggtgcaattgcatggagcatttcctcatccggacccgccgcagcgcaatctgcgggtggcggcactgaccccgccacaatggttaacaatatatgcacgtttatccttggtccgttcggccagtcactcgctgttctcggcattgtcgctatcgggatctcctggatgttcgggcgggcttcgcttgggctggttgccggcgtcgtcggcggcattgttatcatgtttggggcgagcttcctcggccaaacgctcactggcggtagttgatggctgatcgtttggaagaatcgaccctttacctcgcagccacacggcccgcattgtttcttggggtgccactgacattggcagggttattcatgatgttcgccggctttgtcatcgttatcgttcagaacccgctctacgaagtcgttctcgtgccgttatggtttgcagcccggctcatcgtggagcgagactacaatgcggcgagcgtcgtcctgctatttttgcggaccgcgggaagaagcattgatagtgcagtttgggggggcgctactgttagcccaaatccaattagggttcccccacgagggagaggaatggtgtgatgctcggcgcgagtggaacgaccgaaagatccggtgagatctatctcccttatattggccacctcagcgaccatatcgtccttcttgaagacggatcgatcatgaccattgcgagaattgatggcgttgcattcgagcttgaggaaactgaaatgcgcaatgcgcgttgtcgtgcgttcaacacgctgttgcgcaatatcgctgatgatcatgtgtcaatatatgctcacctcgtacgtcatgccgacgtgccatcatcggcgccgcgacacttccgtagtgttttcgccgctagcctgaacgaagcttttgaacagcgcgtgctctccggccaactcctccgcaatgaacacttccttacgttgattgtctacccacaggcggctttagggaaggtaaagaggaggttcaccaagctaagcggaaaaagggaaaacgatctcacgggccagatcaggaacatggaagatctttggcatgttgtcgctggctctcttaaagcgtatggcctgcatcgtcttggcatccgcgagaagcagggtgtgctcttcaccgaaattggcgaagcgctacggttgatcatgactggtcggttcacaccggttccggtcgtcagcggctcactcggcgcttcgatttataccgacagagtcatttgcggcaagcgaggactcgagatcagaacgccaaaagacagttacgttggatccatctattcgtttcgcgaataccctgcaaaaacacggccgggcatgctcaacgcgctgctatccctcgattttccacttgttctcacgcagagtttttcgttcctgactcgcccgcaagcgcacgcgaaacttagcctcaaatcgagccagatgctgagttccggcgataaagccgtgactcaaatcggcaaattatccgaggctgaggacgcacttgcgagcaacgaattcgttatgggctcacatcatttgagcctttgcgtctatgcagacgatctcaatagtcttggggacaggggcgcgcgggctcggacacgaatggcggatgcaggtgccgtggttgtccaagaaggtattggtatggaagcggcctattggtcccaattgccggggaattttaagtggcgcacacgccctggcgcaatcacttcacgcaatttcgcagggtttgtctctttcgaaaactttccagagggcgccagctcaggccactggggcaacgcgattgcccgatttcgtaccaatggcggaacgcctttcgactatatcccgcatgagcacgatgttggcatgacggcaatattcgggcctatcgggaggggtaagacgacgctcatgatgtttgttctagccatgctcgaacagagcatggtcgaccgtgcaggtacggtcgtgttctttgacaaggaccggggtggcgaattgctggttcgcgccacaggaggaacatatttggcacttcacagaggcacacccagcgggttggcgccgttgcgtggcctagaaaacacagcagcctcacacgattttctgcgcgaatggatcgtggctctcatcgagagtgatggtcggggtgggatttctccggaagagaaccgccgtctggtccgtggtatccatcgtcagctctcgtttgatccacaaatgcgttcaatcgcggggttacgtgaatttttgttgcatgggcccgccgaaggcgcaggagcgcggctccaacgctggtgccggggccatgcgcttggctgggcatttgacggcgaagttgacgaagtaaagttagatccgtcgattaccggcttcgacatgacgcatcttctcgaatacgaggaagtatgcgctcccgctgcagcatatctcctgcatcggattggagccatgatcgacggccgccgttttgtgatgagctgcgatgagtttcgcgcctatttgttaaaccctaaattttcgactgtcgtcgacaaattcctcctgaccgttcgaaaaaacaacgggatgctaatactggcaacgcagcaaccagagcatgttctggaatcgccgctaggagccagcttggttgcgcaatgtatgacgaagattttctatccatcaccaaccgcagatcgatcggcttatgtcgatggactgaaatgtaccgaaaaggaatttcaggcgatccgtgaagacatgacggtcggcagccgtaagtttcttcttaaacgagaaagtggaagcgtcatctgcgaatttgatctgcgggatatgcgtgaatatgtcgccgtgctttcggggcgtgccaacacggtgcgctttgcaactcgactacgcgaggcacaagaaggcaactcatctggctggctcagcgaattcatggcccgtcaccacgaggcagaagattgataaggtaggaaacgatgaagacgacgcaacttattgcaacagttttgacctgcagctttctatatattcagcccgcgcgggcgcagtttgttgttagcgacccggcaacggaggctgagacgctcgcgactgcgctcgcgactgcggagaatctcactcagactatagcgatggttacgatgttgacgtcggcctacggcgttactggactactgacttcgctcaaccagaaaaatcagtatccttcgacgaaggacctagacaatgaaatgttttcgccgcgaatgccaatgtcgaccacggcacgtgcgatcaccagcgatacagatcgtgcagtcgtgggtagtgatgctgaagcggacctgttgcgatcgcagatcaccggttccgcaaacagcgctggcattgcggctgacaatctggaaacgatggacaaacgcttgacggcgaatgctgatacgtctgctcagctttcccgatctcgcaatatcatgcaggcaaccgtgaccaatggtttgcttctcaagcagatccatgacgcaatgattcaaaatgtacaggcgacaagcctattaacgatgactaccgcgcaggccggccttcacgaggcggaagaggcggccgctcaacgcaaggagcatcaaaagaccgctgtcatctttggtgccctcccctaaggctgggcgatttgttcatccgcccgcatcctcgccgaatgcgagctcattttatccaacattatgcgacaaaccagtcaagttcaggtccaatcgatgaatttcacgattccggcgccgtttacggccattcatacgatcttcgatgtagccttcacgacaggcttggactcgatgcttgagactatccaggaggcggtgagtgcgccattgatcgcctgtgtcactctttggattattgttcagggtattttagtcatacgcggcgaagtcgatacccgtagcggtatcactcgggtgatcacggtcaccatcgttgttgctctaattgttgggcaggctaactaccaagactatgtggtttccatcttcgaaaagacggtcccaaactttgttcagcagtttagtgtaaccggcttgcctctgcagactgttccggcacagttggatacaatgttcgccgtgacccaggccgtttttcagaaaatcgcatccgaaatcggtccgatgaacgaccaggacatccttgctttccaaggggcacagtgggtcctttacggcacgctctggtctgccttcggagtttacgacgccgttggaattctcacgaaagtgcttctcgcgatcgggcctctgatcctcgtcggatatatttttgatcgcacgcgggacatcgcagctaagtggatcgggcaacttatcacctacggtctcttgcttctcctcttaaacctcgtggcaacgatcgtcatcctaaccgaagcgactgcgctcacccttatgcttggtgtaatcaccttcgccggtacgaccgcggccaagatcattggtctttacgaactcgatatgttttttctgacaggggatgcgctcattgtcgctttgccggcgatcgccggcaacattggaggcagttactggagcggcgcaacccaatctgccagcagcttgtaccgtcgcttcgctcaggttgagcgaggctaggtcgcgcaaaaattcgcctcaatggagaattctatgaagtattgcctgctgtgcctagttgtcgctttgagcggctgccagacaaacgacacattagcgagctgcaaaggcccgatcttcccgctgaatgtggggcgatggcagcctactccgtcagatcttcagctcggcaattcgggtggacgctatgacggggcctgaatatgccatgctagtggcgcgcgaaagccttgccgagcactataaggaagtagaagcctttcaaaccgcgcgagcgaaatcggcgcgacgtctctccaaactcattgcagctgtcgcagctatcgcgattttgggaaatgttgctcaagcgttcgctatagccacaatggtgccgttgagcaggcttgtgcccgtatatctatggatacggccggacggcaccgttgacagcgaggtgtctgtctcgcgattgcctgcaactcaagaggaggccgtcgttaacgcctcattgtgggagtacgttcgcctgcgcgagagttatgatgccgacaccgctcagtacgcctacgacctggtatcgaacttcagtgccccaacagtgcgccaggattaccagcaattcttcaactatcccaatcccagttcgcctcaagtcattcttggcaaacgcggcagggtggaggtcgagcacatcgcttcaaatgatgtaactccaagcacgcagcaaattcgctataaaaggaccctcgtcgttgacggcaaaatgcctgtggtgagtacgtggaccgcgacagttcgctacgaaaaggtgaccagcttgcccggcagattgagactaaccaacccggcaggtctggttgtcacctcctatcagacatcggaagataccgtttcaaacgtaggccacagcgaaccatgatcagaaaagcacttttcattttagcatgtttatttgccgctgcgactggtgcggaggctgaagacactccaatggcgggcaagctagatccgcgcatgcgttatttggcttacaatcccgatcaagtggtgcgcctctcgacggcggttggagctactttggtcgtaacattcgccacgaacgaaacggtgacagcggttgccgtttcaaatagcaaagatctagcagccctaccgcggggaaattatctatttttcaaggcaagccaggtcctcacgcctcagccagtaatcgtgctaaccgcaagcgactccgggatgcgccgttatgttttcagtataagttccaagactctgtcccacctcgataaagagcagcccgatctctattacagcgtccaattcgcctaccccgccgacgatgcggcggctcggcgaagggaggcacaacagaaggctgttgtggacagactacacgcggaagcacaatatcaacggaaagctgagaatttattggatcagcctgtcacagcccttggtgcggcggacagtaattggcactacgtcgcccaaggcgatcgttcgctgttgccactcgaagtcttcgacaatggatttacgacggtattccactttccgggcaatgtacgcataccctccatctacaccatcaatcctgatggcaaggaagctgttgccaactattcagttaaagggagcgatgtcgagatttcttcggtttcccgaggttggcgtctgagggatggccacacagtactatgtatctggaacaccgcttacgatcccgttggccaaaggccgcaaacgggcacggtgaggcccgatgtgaaacgcgtcctgaagggggcgaagggatgaataacgatagtcagcaagcggcacatgaggttgatgcatctggatccctggtctccgacaaacatcgccggcgtctttcggggtctcagaaattgatcgtcggaggtgtcgttctcgcgttatcattaagcctcatttggctaggtgggcgccaaaagaaggtgaatgagaacgcatcgccgtcaactttgatcgcaacaaacaccaagccatttcatccagctccgattgaggtgccgccggatcctccagcggttcaagaggctgttcagcctgctgctcctctaccgccgaggggcgaaccggagcggcatgagccacggccggaagaaacaccgatttttgcatatagcagcggcgatcaaggggtcagcaaacgcgccattcagggcgacacgggccgaagacaagaaggcaagcgtgacgacaactccttgccgaatggcgaagtgtccggcgagaacgatttgtcgatacgtatgaaacccaccgagctgcagcccagcagcgccacgctcttgccgcaccccgattttatggtaacgcaagggacaataattccgtgcatcttgcaaaccgcaatcgacacaaatttggcaggctatgtaaagtgtgtcttgcctcaggatattcgtggaacaacgaacaatatcgtgcttcttgatcgtggcaccaccgttgttggcgaaatacagcgtggcttgcaacagggagatgggcgcgtttttgtgttgtgggatcgcgccgagacacctgaccatgcgatgatctcgttaacatcgccaagcgcggacgaactcggtcgctcaggattgccgggctcggtcgacagccacttctggcagcgttttagcggagctatgctcttgagtgttgttcaaggcgccttccaggcagctagcacctacgccggcagctcgggtggcgggatgagcttcaacagctttcaaaataacggtgagcagacaactgagacagcccttaaggcaaccatcaacataccgccaaccctgaagaagaatcagggtgacaccgtttccattttcgtagcacgggacctcgatttctttggtgtttaccagctccgcctgactggcggcgccacgcgggggaggaaccgccgctcttaatgaattcaaatttccgcttagagataggatacattgtaaatggaagtggatccgcaactacgctttcttctgaagccgattttggaatggctcgatgacccgaagactgaagaaattgcgatcaatcgacctggagaggcatttgtgcgccaagccggcatttttaccaagatgcctttgcccgtctcttatgatgatcttgaagatatcgctattttagcgggcgcgctgagaaagcaggatgtcggaccacgtaaccccctctgcgccactgaacttcctggtggtgaacgactacaaatctgtctgccgccgaccgttccctcgggcaccgtcagcttgaccattcgacggccaagctcgcgtgtttctggtcttaaagaagtctcctcccgttatgatgcttcgaggtggaaccagtggcagacacgaaggaaacgccaaaatcaggatgatgaagctatccttcagcattttgacaacggggatttggaagcgtttctgcacgcatgcgtcgtcagccgactgacgatgttgctatgtggccctaccggaagcggcaagacaacaatgagcaagaccttgatcagcgccatccccccccaggaaaggctaatcaccatagaagatacgctcgaactcgtcattccacacgataatcatgttagactactctactccaagaacggtgctgggctgggtgctgtgagcgccgagcacttgctccaagcaagtctgcgtatgcggccggaccggatattgcttggcgagatgcgcgacgatgcagcatgggcttatctgagtgaagtcgtctcgggacatccgggatcgatttcaacaatacacggcgcgaatccaatccaaggattcaagaaactgttttcccttgtcaaaagtagcgcccaaggtgctagcttggaagatcgcacactgattgacatgctctctacggcgatcgatgtcatcattccattccgtgcctatgaggacgtttatgaagtaggcgagatctggctcgcggcggacgcacgacgccggggcgagaccataggcgatctccttaatcaatagtagctgtaacctcgaagcgtttcacttgtaacaacgattgagaacttttgtcataaaattgaaatacttggttcgcattttcgtcatccgcggtcagccgcaattctgacgaactgcccatttagctggagatgattgtacatccttcacgtgaaaatttctcaagcgctgtgaacaagggttcagattttagattgagaggtgagccgttgaaacacgttcttcttatcgatgacgatgtcgctatgcggcatcttattatcgaataccttacgatccacgccttcaaagtgaccgcggtagccgacagcacccagttcactagagtactctcttccgcgacggtcgatgtcgtggttgttgatctaaatttaggtcgtgaagatgggcttgagatcgttcgaaatctggcggcaaagtctgatattccaatcataattatcagtggcgaccgccttgaggagacggataaagttgttgcactcgagctaggagcaagtgattttatcgctaagccgtttagtacgagagagtttcttgcacgcattcgggttgccttgcgcgtgcgccccaacgttgtccgctccaaagaccgacggtctttttgttttactgactggacacttaatctcaggcaacgtcgcttgatgtccgaagctggcggtgaggtgaaacttacggcaggtgagttcaatcttctcctcgcgtttttagagaaaccccgcgacgttctatcgcgcgagcaacttctcattgccagtcgagtacgcgacgaggaggtttacgacaggagtatagatgttctcattttgcggctgcgccgcaaacttgaggcggatccgtcaagccctcaactgataaaaacagcaagaggtgccggttatttctttgacgcggacgtgcaggtttcgcacggggggacgatggcagcctgagccaattgcatttgattaatttaggtgactgaggacgcggccagcggcctcaaacctacactcaatatttggtgaggggttccgataggtccctcttcaccaattgctcgatggcttctctccagcaaagaatgacgcgagcgcggcggtagccagcttgtggccgaaagctcgagcggtctccaaccccaacggatcaaaatgacttcgagcgacctcgagcaacgcaaccgggaacatgcgtgaggtctgaacgagaacggatttttctgtagttgaagggatcggataacttttcggggccacgcgaaatgatccatctgccagcatgctttcgaaatcgtccaacgcgcgccttaaaatcatttgtagcgacttcgagggactgtattgccgaacgaggttgtcatatgttttcgacacttgaggcgcgggcggtcgcgctgaaagaaaaacctggagctttttcggggacggaggtggactaagggcatccacagttagcttaagttgtcgatcgggactgtaaatgtgatcggcgacgagaggctcacgttgctggtctttctcgtcggctttttcaggcaagtgctggaggtccagcttctggggaacaagtgtcgggttgggatggtggatctcgggtcgagcaccagcaagccgccgtgcttcgccgaccgacaatgcgggcttgcgaattgccatcttcaagcctccaagattttgctgatcagtttcgaaatgaccacgacttcctccatcgcaatccgaagattcctctctatgaggcgcatcgtcggatcagttcccgtgtttagtaatgtaagatgcaacatgccgcgttctttcatcgcggcaaatgcatctctttcatgcatgggagacggtacaactggaaggctctctagcgtctctgacatcctgcgttgcgatgttgtcaatcggccgaccgggacgcgttggcgcaaaacagctgtaggaattgccaaattttcactcaacagcagctcgatgacgtagcggtaggtagatagtgcctcatcgatgtcgagcggcgttagcatggtggggatcagaagcaggtttgagctagcgatgattgtgttgttgagctcgctcgagccgccacgcgtatcggccaacgcataatcaaatccttcgagctcggcattttcataggctgcttcaagaaggggcatttcgtcggcggaatagacttcacagcgaggatcccaggtactgctttgtaaggcgttttctctccatcgcgtcagaggccggttttcgtcggcatcaaagagggccactcgtttaccgtcatttgccaaagcagcgcaaaggcccatgagtgcggtggttttgccagcaccccctttgaaagaacaaaacgtcaaaagttgcatattctgatcccgcctatcctgtgaaaccggagtgcatttgtatttttgttcgtataaatgtttttgtgattatcgatgagtaaaagcgttgttacactatttttatttcacattcgttataagacaattgcaaatgtagcaagtatattcagtattgactgtaaatgtactgttgatttcatattgagcagggctagacttccatccgtctacccgggcacatttcgtgctggagtatccagaccttccgctttctttggaggaagctatgtcaaaacacaccagagccacgtcgagtgagactaccatcaaccagcatcgatccctgaaagttgaagggttcaaggtcgtgagtgcccgtctgcgatcggccgagtatgaaaccttttcctatcaagcgcgcctgctgggactttcggatagtatggcaattcgcgttgcggtgcgccgcatcgggggctttctcgaaatagatgcagacacacgagaaaagatggaagccatacttcagtccatcggaatactctcaagcaatgtatccatgcttctatctgcctacgccgaagaccctcgatcggatctggaggctgtgcgagatgaacgtattgcttttggcgaggctttcgccgccctcgatggactactgcgctccattttgtccgtatcccggcgacggatcgacggtcgctcgttactgaaaggtgccttgtagcacttgaccacgcacctgacgggagaaaattggatgcccgatcgcgctcaagtaatcattcgcattgtgccaggaggtggaaccaagacccttcagcagataatcaatcagctggagtacctgtcccgaaagggaaagctggaactgcagcgttcagcccggcatctcgatattcccgttccgccggatcaaatccgtgagcttgcccaaagctgggttacggaggccgggatttatgacgaaagtcagtcagacgatgacaggcaacaagacttaacaacacacattattgtaagcttccccgcaggtaccgaccaaaccgcagcttatgaagcaagccgggaatgggcagccgagatgtttgggtcaggatacgggggtggccgctataactatctgacagcctaccacgtcgaccgcgatcatccacatttacatgtcgtggtcaatcgtcgggaacttctggggcaggggtggctgaaaatatccaggcgccatccccagctgaattatgacggcttacggaaaaagatggcagagatttcacttcgtcacggcatagtcctggatgcgacttcgcgagcagaaaggggaatagcagagcgaccaatcacatatgctgaatatcgacgccttgagcggatgcaggctcaaaagattcaattcgaagatacagattttgatgagacctcgcctgaggaagatcgtcgggacctcagtcaatcgttcgatccatttcgatcggacgcatctgccggcgaaccggaccgtgcaacccgacatgacaaacaaccgcttgaaccgcacgcccgtttccaggagcccgccggctccagcatcaaagccgacgcacggatccgcgtaccattggagagcgagcggggtgcccaaccatccgcgtccaaaatccctgtaactgggcatttcgggattgagacttcgtatgtcgctgaagccagcgtgcccaaacaaagcggcaattccgatacttctcgcccggtgactgacgttgccatgcacacagtcgagcgccagcagcgatcaaaacgacgtcatgacgaggaggcaggtccgagcggagcaaaccgtaaaagattgaaggccgcgcaagttgattccgaggcaaatgtcggtgagcccgacggtcgcgatgacagcaacaaggcggctgatccggtgtctgcttccatccgtaccgagcaaccggaagcttctccaacgtgtccgcgtgaccgtcacgatggagaattgggagaacgcaaacgtgcaagaggtaatcgtcgcgacgatgggcgcggggggacctagactagtagacaggaaggaccgaataatggcaaatggtcagttcacgatacgctctgctcgcccggcctccgtcggactgacaggcgaacggcgtggagccgcatccgcctctagctctgcactgtccaatgttcaaagagatgttagggataggctgattccaactagctcaccaagattaccaaatgcagccatattgcgtgattcctcgggaagagcgtcgactggtctgcggtacatggcggctactcttcattggtctgcgatcgcgccattatcgctaataaacagcaacgacctggctccggccgcttatgactttgagacgcgaaataacgcaagaaatgtgactgccaaagtcggcagggcagtccctgttcccaagcaaggcgggctcggcaaaacgctcgcacccgtaccccttagtacacgtatatcaagggtcaattccgaccgaagactgcccgctgacgcagaagaccgccctgaaacgcgcgacccccagaaaggacgtggcagtcatggtgcgacgccaaccttacatgaaaagattggaaccgcgtttgctcgaagattgcgaaagcatacgtactatattgtttgcagttgctgccagacccggagcgcgttgacgatgggtgcaaagatttcggtgaagtcatgaactccagcaagacttcgccccagcgtatgaccctgagcatcgtatgttcgctggcagccggtttttgtgcggccagctgctatgtaacgttccgccggggcttcaacggcgaagcgatgatgacgttcgacgttttcgctttttggtatgagaccccgctttacttgggttatgccagcaccgtcttctggcgtggtttatctgttgtcatctttacctcgctgatcgttctttcaagtcagctcatcatatcgctgcgcaatcagaagcatcatgggacagctcgttgggcagaaattggcgaaatgcggcatgctggttatctgcagcgttacagtcgcatcaaggggccgatctttggaaagacatgtggtcccctttggttcggcagttatttgaccaatggcgaacagccacacagtcttgtcgtcgcgccaacgcgtgctggcaaaggcgtcggcatcgtcattccaacgctgttgaccttcaagggctcggtaatcgcccttgacgtcaagggagaattgtttgaactgacgtccagagcacgcaaagcgagcggcgacgcagttttcaagttctcccccctagatcctgagcggaagactcattgttacaatccggtcctggatattgccgcacttccgcccgaacgccagttcactgaaacacgccgtctagctgcgaaccttattacggctaagggaaagggagcagaaggctttattgacggcgcacgtgacctgttcgtcgcgggaatccttacctgcattgagcgtggcacaccaacgattggcgcggtatatgacctatttgcgcagcctggcgaaaagtataagctttttgcgcaactcgcggaggaaagcctaaacaaagaggctcagcgtatcttcgataatatggcgggcaacgacacgaaaattctgacatcgtacacctctgtgctgggcgacggtggactgaacctgtgggctgatccgcttatcaaagcagcgacaagccggtcagacttttccgtttacgatctccggaggaagaagacctgcatttatctttgtgtcagtcccaacgatctggaggtcttggcaccacttatgcgcctgatgtttcagcagctcgtgtcaatcttgcagagatcgctgccaggtgaagacgagtgccatgaagttttatttctcctcgacgaattcaaacacctgggcaagcttgaggccatagagaccgcgatcacaaccatcgccggttacagaggccgctttatgtttattattcaaagtctttcggccttgtcgggcacatacgatgacgcaggaaaacaaaactttctgagcaatactggcgtacaagtatttatggccacggctgatgacgaaactccaacctacatctcaaaagctatcggcgaatatacgtttaaagcgcgttcgacctcttacagtcaagccagaatgttcgaccacaacatccagatttctgatcaaggtgcagcccttttgcgccccgaacaagtgcgcctgctagacgatcagagtgaaatcgttctcatcaaagggcgacctccactcaaattacgaaaggtgcagtattattccgatcgtacgctgaaaggccttttcgaacgccagatgggctctctgcctgagcccgcacccttgatgctttccgactatagcaacgatcaagttcaataccacttggctccgatagcaaattttaatgaggatgctgcaccgcaaaacagaactgtggccgaggaccatggaagtgttaaagtcggtgctgatatccctgaacgcgtgatgggaataaatggtgacgaggaacaagccgatgcgggcgagataccgccggaatcggttgtgcctccagaattgacgctcgctctgaccgctcaacagcaattgttggaccagattattgcacttcagcaaagatcgaggtccgcaccggcatagcctgcgaaatgatcttaatggtgcaattcgtttcaggcggcatgttgcggttcaacaaagtgtacgccagatcccaattggccctttacgaggtgtcggtatgacaggaaagtcgaaagttcacataagaggttcggctgacgcgcttcctgacgttcctggcggaagtactaccgccccttttttaaccgaaccttctcgggatcaggttgatgcctcgtttgaggtccaaaccgactacagccagtctacttccgtgtcgtttacctatgatggtgttggacttggtcctgccgagcgtgcggcttacgagaactggtgcgaaccgggccggcccacttggaaagatcttataatcaaggcacgtgtcgatccgattgacgatgtgacctggctccgagatttagaagaggacaccccctcaaccttcagatacgaagggatgcctctgggcatcggggaacgacaggcctacgaaaattggcaagaggacgctcagccgacatgggaagaccttgttgtcagcgcacgcttgacggaacttggccgtccacacgggattaccggcgagtatacatccctcgcaggatcgaagaatacaagttcaatttcattgaagcgaaagcggagcaacttaattgatgatgagaattcatccggatcgttttcatatgacgggatgaagctcggggaagccgagcgttctgcatatggtgactgggccgaggcggagccacccacgtggaaagatttggtattgagggcacgcgtttcctcgatcaatgactctgcttggctttttgattcacaaacatcttcatcatcatttgaatacaacggtgttcccttgggcgagccggaacggcaggctctcagacaatggcaaggagacgctcagcctacctgggaagatctcgttgttaacgcgcgtatggcagaactttgccatgctggttggattgaaggtcaaaaaggttgctttgaagagcgcggggaggctctgcccgcgtcggaacgcggttcgcaacgccccattggtcaacggacagattcctccgattcttttgtgtatgatggcacaaggctcggagcacctgagcgaactgcttatgaacgctggagtaagagggaacgcccgacttgggaagatctcatcttagatgcacaccaggccaggactgaaagtgacgctgttacgacccaagcgattggtcagtcgtcctcaccggttttcttatatgaaggaaagtcgctcggagacagggaacgaaaggcttacgaaaaatggcggcagccagcccaaccgcgatggcaaaatcttgtagtgaacgctcgtctggcagaaatcgatccctcagcctggattgccgatgagcgcgatccgcttgatgatagcgacgcgcttggtcgcccgtcgtacacaagcttgacggatagatcagacgtccctttagacgatcaatcaatctatcgtcgttccgacctagtaagggagcaggtgccagaatcgtctcaaaggcaattcgcagcatgttcagaatctgaaacgaggcctgtgcaatggtttactgcttctgggtcagatgcaaacaatacggaaaatatcaccgccagcgatcccgtcgatcgcacgggtggagttaagcggctaggctccaaaagcgacagaaccgttacagcttctatccatgacgtgaattccagcacaaggcgactgttgcttaacgaatttggatcggaggctccgcgcccttcgccagaaaagactgttcgcttaagaagcgacaatattggcacctatgggagccggaaaaatgaacgagcgcggctcgcgaccgaaaccggtgcgtatgagtcggagcatattttcgggttcaaggctgtccacgatactgcgagagcgacgaaagagggccggcgtctcgaaaggcccatgcccgcctaccttgaggataaggggcttcatcgccaacatattggcaccgggagaggacggaccaaacttgtcgggcgcggatggccggatgacacaagctatcgctcggatcaaagggcaactctgtcggaccccgttgcgcgctcggaaggcgcgacggcctcaaatgggtatcaattgaaccaattgggttacgcgcaccaactcgctagcgatggcctgcaaagtgaatcgcccgatggtgttgccttgccaattcaagtggcaacaacgagctacaactatacagtgagccgcgatcctgtccttgttccgccggataaaaacgaagcccctcaattgctgcatcttggtccccgtggtcaaaccgaagctgttcttgcccgcgaaacagcattgactggaaaatggccgactctcgagcgtgagcagcaagtgtatcgcgagtttttggccttatatgacgtaaaaaaagatcttgaggccaaatcagtcggcgtaagacggaaaaaaaaagaagttatttctgcgttagaccgaactgcgcgcttgataagcacgtcgccttcgaaagctcgatccaaagcagagactgaaaaagccattgatgagctcgatgatcgacgagtttatgatccgcgtgatcgagctcaagacaaagcgtttaaacgctgataagtcgccaatatagtgatcatttgcagtattcgcatcgatcgctggttgatattctgccgctggtcgaccggctgctcgtcgccaaaaatgctcacagggatacgatggcctcggtcaggccgcgtgcgtcctgtctttccagttcctccctttcagctcgattgtggcatcatttattgcctgctcattgcagttgaaacgcgatatccgtttcaagacccgggtatggatggtactttggagatatgagcacttgccagacttcccggtcggagacttaaaaattccgataagaggttacggacgacggaccttataagtggatcgtctagtggtggcgccgatcaaaacagttccgcccccggctttgctcaaagtagcaaagcagctttatctcgggttgcggaggattttctagaaaaccgcaattttgcaggagagaacatatggccatcatcaagccgcatgtgaacaaaaataggacaacctcgccgatagagagaccggagtctctcatagaggaaatgagcggcagtcatccgccgagtggttttaccaacctggatctcgctatgatcgagctggaggactttgtccatcggtgcccgctcccagaagacaatcttgctggtcagaaggagtgagacgatggatccgtctagcaatgagaatgtctatgtgggtcgcggtcacaacatcgaaaatgatgatgacactgaccccaggcgttggaagaaggcgaatatcagttccaacaccatctccgatattcagatgacgaatggcgaagacgtacaatcagggagccctacccgaacggaagttgtaagcccacgtctggattatggatcggtcgactcctcctccagcctttattctggcagcgagcacggaaatcaagctgagattcaaaaagagctgtccgtcttgttctcgaacatgtctttgccaggcaacgatcggcgcccggacgaatacattctcgtgcatcaaacgggacaagatgcttttactggtattgccaaaggcaacctcgaccaaatgcccaccaaggcggaatttaacgcgtgctgccgtctctacagggacggagccggtaattactacccgccacctctcgcattcgacaagattagcgttccagagcaactggaggaaaaatgggggatgatggaggcgaaggaacgtaacaaactgcggtttcagtacaagttggacgtatggaatcatgcgcacgctgatatggggatcacgggcacagagatcttttatcaaacagataagaacataaagctcgaccggaattataaactaagacctgaagaccgatacgtacaaacagaaaaatacgggcgccgggaaattcaaaagcgatatcaacacgaactccaggctggttcgctgctgcccgatattatgatcaaaactccccaaaatgacatccacttcgtgtacaggtttgccggcgacaattacgccaacaaacagttcagcgagtttgaacacaccgtcaagcgcaggtatggcgacgagactgagatcaaattgaagtcaaagtcaggcattatgcatgactcgaaatatctggaatcctgggaacggggcagtgcggatattcgcttcgcggaattcgttggggaaaatagagctcacaatcggcagtttccaactgcgacagtaaatatgggacagcagccagacgggcagggcggtttgacccgcgaccgtcatgtgagcgttgacttcctaatgcaaagcgcacccaattcgccttgggcgcaagctttgaaaaagggagaactgtgggatcgcgttcagttgcttgctcgcgacggcaaccgctatctgtcgccgcccagattggaatattctgaccctgcacatttcaccgagttgatgaaccgggttggtttacccgcatcgatgggtcggcaaagccatgcggctagtatcaaattcgaaaagtttgacgcgcaggcagcggttattgtcttaaatggcccagagttacgtgacattcatgacttgtctcctgaaaaactgcaaaatttgtccaccaaagatgtcatcgtcgccgatcgcaatgagaatggtcagagaactggcacgtacaccagcgtcgcggaatatgagcgcttgcagttaaggctgccacccgatgcagcgggggtgcttggtgaagcaactgacaaatattcacgtgatttcgttcggccagagccggcgtcgcgtccaatcagtgacagccgcaggatatacgaaagtcgaccgcgtagccaaagcgtcaacagcttttgacgttcctgctgccgcgtcaacgaggaagctcgtttgacccgggtttgccaatgaaagggctcaatcatggtgaacactacaaagaaaagttttgcgaagtcgcttacggcagatatgcgccgttctgctcagcgcgttgtcgagcaaatgcgaaaagcattgattaccgaagaagaggcgctcaagcggcaagccagactggagagtcccgataggaagcgaaagtatgctgctgatatggcgatagtcgacaaactcgacgtagggtttcgaggcgaaataggctataaaattcttggaaataaccggcttcgagtagacaaccataaagaattaacgcgtgagcacggtagacttcgcaaaaccaaaacggttctgaagcgtaacccggtgacgcaggaagtctatttgggtttatatgaaaggaagtcctggttaagtgtcagcagccatttgtatgctgcggacggcacactccgcatgaagcacgtgaaatacaaagacggacgttttgaggaaaaatgggagcgcgacgaaaatggcgacctgatccgcacaaggtacgccaaccgtggcaggctctttcaacctgtatccgagaaaatgggcgcgccgtatcggagcggccctgacgaccggctctatcgcgatctaacccgtcgaaacggtttcagacgggagacattcgaacgggacgatcacggaaacctcgagcgtatcggcagcaaccatgtcggcttttccaagatttcagtgaaggcacccaatcgtcaaacctcccagacgaagattcaaaaacttggtggcgctttcaacaaatcttttaggtcccttctggacaaggagggcaatgaaatgggccgcgatattttgagccatcgacggctctataacaagcggtctgctgtctacgatgaagctaccggacaattgaagagtgccaagcataccttcggcaagatctacaggagcgaaaccgaatatctcagcgcgggcctcaagaaggtttcaaaaaagatactcggggtgacggtctaccggaaatttgcggcgctcagcgagcgagaatccgaggctgagagactgcgtagttttgaatccggtgcgcatcgccagatctggcaggagcgggcagcgattcccggttcgcccctcccggagactgatgacattcatttcgcacagcagtcgcacctagccaaagccaaccctgatcacgtcgaagctgacgtcacgcgtgtgacagatcaacatgttgatgttgctggacaaacatcatcgtctccccaacggaacttggaaggatggttagattctcaatcacgatacaagccagcaaacatgctgttgtcaaatccagaccttcaagcgaacggacctcgcccatacgaagggttagctcatctcaccctccggcgcgataatgaatctgacgggcacaaggagaatgatcagcggctgcgacatttctcccagccagagccgttggtgttaccgcatcccgggtcgccggaaataactaaggtgtttggctcgcggggagagccggcacacccgagtggaaatctgcacacggcggttggagaaacggcttgcgaaggaccggtgatgtcttcatcctcggacaatcatcagccagctccaggacagcaagaacttttaagtttccttcataatgcgccagccccagtttctgtggcaatacatgatgatcaagagcgacttgcgggggaggcgcccggcggctctttcagaggtagctcagggcgaacgagttcaatgtcggagagtatcttcgacgaagatgtacaagggcatttggtacgggattattcgatcaatactactaacgggtttattgacccgcaatcgttgttcggtgaaccggacttatcgagaggtccaaaatcggggccagaaattccatcggaagattaccatttgtcagcttcggaacaggaaaatttgctgaatcaattgcttagtgtgccactgccggttccttcaccgaagcccgaatgcgcgaggtctatgattttcgaaggttcacgttcaagagagcgttccacctccagagggttctaaggtggaacgcgtctaggcttgcctatcatcaccacctcatgatggtcgcggagaccttcgaagagatatccgacatcattggagaagctgggccggaaactagtgtacctcgcgaatgcatctagatccaatccaatatgcatggcatgccgaatccatgtgggagtttattcttgacacagatatttatgatataataactgagtaagcttaacataaggaggaaaaacatatgttacgcagcagcaacgatgttacgcagcagggcagtcgccctaaaacaaagttaggtggctcaagtatgggcatcattcgcacatgtaggctcggccctgaccaagtcaaatccatgcgggctgctcttgatcttttcggtcgtgagttcggagacgtagccacctactcccaacatcagccggactccgattacctcgggaacttgctccgtagtaagacattcatcgcgcttgctgccttcgaccaagaagcggttgttggcgctctcgcggcttacgttctgcccaagtttgagcagccgcgtagtgagatctatatctatgatctcgcagtctccggcgagcaccggaggcagggcattgccaccgcgctcatcaatctcctcaagcatgaggccaacgcgcttggtgcttatgtgatctacgtgcaagcagattacggtgacgatcccgcagtggctctctatacaaagttgggcatacgggaagaagtgatgcactttgatatcgacccaagtaccgccacctaataatgtctaacaattcgttcaagccgacgccgcttcgcggcgcggcttaactcaagcgttagatgcactatacgtaccaatccaaatcggatccccctgcagggctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagcagatctatcgatggtacctatctgcagacggaagggattcctgttaattaaaacagcttgcgtcatgcggtcgctgcgtatatgatgcgatgagtaaataaacaaatacgcaaggggaacgcatgaaggttatcgctgtacttaaccagaaaggcgggtcaggcaagacgaccatcgcaacccatctagcccgcgccctgcaactcgccggggccgatgttctgttagtcgattccgatccccagggcagtgcccgcgattgggcggccgtgcgggaagatcaaccgctaaccgttgtcggcatcgaccgcccgacgattgaccgcgacgtgaaggccatcggccggcgcgacttcgtagtgatcgacggagcgccccaggcggcggacttggctgtgtccgcgatcaaggcagccgacttcgtgctgattccggtgcagccaagcccttacgacatatgggccaccgccgacctggtggagctggttaagcagcgcattgaggtcacggatggaaggctacaagcggcctttgtcgtgtcgcgggcgatcaaaggcacgcgcatcggcggtgaggttgccgaggcgctggccgggtacgagctgcccattcttgagtcccgtatcacgcagcgcgtgagctacccaggcactgccgccgccggcacaaccgttcttgaatcagaacccgagggcgacgctgcccgcgaggtccaggcgctggccgctgaaattaaatcaaaactcatttgagttaatgaggtaaagagaaaatgagcaaaagcacaaacacgctaagtgccggccgtccgagcgcacgcagcagcaaggctgcaacgttggccagcctcgcagacacgccagccatgaagcgggtcaactttcagttgccggcggaggatcacaccaagctgaagatgtacgcggtacgccaaggcaagaccattaccgagctgctatctgaatacatcgcgcagctaccagagtaaatgagcaaatgaataaatgagtagatgaattttagcggctaaaggaggcggcatggaaaatcaagaacaaccaggcaccgacgccgtggaatgccccatgtgtggaggaacgggcggttggccaggcgtaagcggctgggttgcctgccggccctgcaatggcactggaacccccaagcccgaggaatcggcgtgagcggtcgcaaaccatccggcccggtacaaatcggcgcggcgctgggtgatgacctggtggagaagttgaaggcagcgcaggccgcccagcggcaacgcatcgaggcagaagcacgccccggtgaatcgtggcaagcagccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggcaggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctagctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagccgaagagctgcaaaaagcgcctacccttcggtcgctgcgctccctacgccccgccgcttcgcgtcggcctatgcatataattgtggtttcaaaatcggctccgtcgatactatgttatacgccaactctgaaaacaactttgaaaaagctgttttctggtatttaaattaaaaatgaagcgtacgttggaatcgcttctacaaaactcacagaaacaatcaaacaaacatacacagcgatttattcacacgaacccgaattacaacggtatatatcctgtcagccaacaccaaaacatcaaaaaaatcgggatcaggatcaggatctgcggccgcatcctgcaggtcgactctagaggatcctcatcgctatcaactttgtatagaaaagttgggccgaattcgagctcggtacggccagaatccggtaagtgactagggtcacatcgaattcccataggattggggccagaatggccgcggccgcatcaggatattcttgtttaagatgttgaactctatggaggtttgtatgaactgatgatctaggaccggataagttcccttcttcatagcgaacttattcaaagaatgttttgtgtatcattcttgttacattgttattaatgaaaaaatattattggtcattggactgaacacgagtgttaaatatggaccaggccccaaataagatccattgatatatgaattaaataacaagaataaatcgagtcaccaaaccacttgccttttttaacgagacttgttcaccaacttgatacaaaagtcattatcctatgcaaatcaataatcatacaaaaatatccaataacactaaaaaattaaaagaaatggataatttcacaatatgttatacgataaagaagttacttttccaagaaattcactgattttataagcccacttgcattagataaatggcaaaaaaaaacaaaaaggaaaagaaataaagcacgaagaattctagaaaatacgaaatacgcttcaatgcagtgggacccacggttcaattattgccaattttcagctccaccgtatatttaaaaaataaaacgataatgctaaaaaaatataaatcgtaacgatcgttaaatctcaacggctggatcttatgacgaccgttagaaattgtggttgtcgacgagtcagtaataaacggcgtcaaagtggttgcagccggcacacacgagtcgtgtttatcaactcaaagcacaaatacttttcctcaacctaaaaataaggcaattagccaaaaacaactttgcgtgtaaacaacgctcaatacacgtgtcattttattattagctattgcttcaccgccttagctttctcgtgacctagtcgtcctcgtcttttcttcttcttcttctataaaacaatacccaaagagctcttcttcttcacaattcagatttcaatttctcaaaatcttaaaaactttctctcaattctctctaccgtgatcaaggtaaatttctgtgttccttattctctcaaaatcttcgattttgttttcgttcgatcccaatttcgtatatgttctttggtttagattctgttaatcttagatcgaagacgattttctgggtttgatcgttagatatcatcttaattctcgattagggtttcatagatatcatccgatttgttcaaataatttgagttttgtcgaataattactcttcgatttgtgatttctatctagatctggtgttagtttctagtttgtgcgatcgaatttgtcgattaatctgagtttttctgttaattaacagatggcctcctccgagaacgtcatcaccgagttcatgcgcttcaaggtgcgcatggagggcaccgtgaacggccacgagttcgagatcgagggcgagggcgagggccgcccctacgagggccacaacaccgtgaagctgaaggtgaccaagggcggccccctgcccttcgcctgggacatcctgtccccccagttccagtacggctccaaggtgtacgtgaagcaccccgccgacatccccgactacaagaagctgtccttccccgagggcttcaagtgggagcgcgtgatgaacttcgaggacggcggcgtggcgaccgtgacccaggactcctccctgcaggacggctgcttcatctacaaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcaggtgaagttcatcggcgtgaacttcccctccgacggccccgtgatgcagaagaagaccatgggctgggaggcctccaccgagcgcctgtacccccgcgacggcgtgctgaagggcgagacccacaaggccctgaagctgaaggacggcggccactacctggtggagttcaagtccatctacatggccaagaagcccgtgcagctgcccggctactactacgtggacgccaagctggacatcacctcccacaacgaggactacaccatcgtggagcagtacgagcgcaccgagggccgccaccacctgttcctgtagcggccaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccggccagaatggcctcaagtttgtacaaaaaagcaggctccggccagaatggcccggaccgggttaccgaattcgagctcggtaccctgggatccgatatcgatgggccctggccgaagcttggtcacccggtccgggcctagaaggccgatctcccgggcacccagctttcttgtacaaagtggccgttaacggatcggccagaatggcccggaccgggttaccgaattcgagctcggtaccttggtgtttgaataaatgatataaatggctcttgataatctgcattcattgagatatcaaatatttactctagagaagagtgtcatatagattgatggtccacaatcaatgaaatttttgggagacgaacatgtataaccatttgcttgaataaccttaattaaaaggtgtgattaaatgatgtttgtaacatgtagtactaaacattcataaaacacaaccaacccaagaggtattgagtattcacggctaaacaggggcataatggtaatttaaagaatgatattattttatgttaaaccctaacattggtttcggattcaacgctataaataaaaccactctcgttgctgattccatttatcgttcttattgaccctagccgctacacacttttctgcgatatctctgaggtaagcgttaacgtacccttagatcgttctttttctttttcgtctgctgatcgttgctcatattatttcgatgattgttggattcgatgctctttgttgattgatcgttctgaaaattctgatctgttgtttagattttatcgattgttaatatcaacgtttcactgcttctaaacgataatttattcatgaaactattttcccattctgatcgatcttgttttgagattttaatttgttcgattgattgttggttggtggatctatatacgagtgaacttgttgatttgcgtatttaagatgtatgtcgatttgaattgtgattgggtaattctggagtagcataacaaatccagtgttccctttttctaagggtaattctcggattgtttgctttatatctcttgaaattgccgatttgattgaatttagctcgcttagctcagatgatagagcaccacaatttttgtggtagaaatcggtttgactccgatagcggctttttactatgattgttttgtgttaaagatgattttcataatggttatatatgtctactgtttttattgattcaatatttgattgttcttttttttgcagatttgtccggtctctaaccatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaacttcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgtatgcccgacggcgaggatcttgtcgtgactcatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgcgcggaaggaggaaagtgactccttcgttgcgtagacagtatgaaaatatttttactgtgatacttacaagttgatatatggttgtgtgtaacttatttatttgagaggtattttaacacaccttagaactaaaacttaataaataaatatttctctatctttaaaggcacatattacgtggctaaggcaattacagctgatatactgtaaaactcatgtcgccactaaattcttctaacacgcgttctgtctctttccaagggactccgaatatgccactatttatctgtggcatttccaatttatattcccctattgggtatttgatgtggccgtttaaatagtcaccgattgaatcttcacttgttcgagttttgtcttttgcttctctaaaggtcttcaatttatctaaagcaagttttgtataattcaaaatactttgcttttctccatgacttgaacctccaaatgatgaggtaccctgggatccgatatcgatgggccctggccgaagcttggtcacccggtccgggcctagaaggccagcttcggccgccccgggcaacttta

SEQ ID NO: 111 - DNA, 39361 bp, Artificial sequence
  Synthetic construct
ttatacaaagttgatagattgtatgaattcatttacaattgaatatatcctgccattttacacctcgatatatcctgccacaaattccatgtacacagtacattaaaaacgtccgcaatgtgttattaagttgtctaagcgtcaatttgtttacaccacaatatatcctgccaccagccagccaacagctccccgaccggcagctcggcacaaaatcaccactcgatacaggcagcccatcagtccactagagggcccgccgagaatgaacgccaagaggaacaagcatgaaaccgcaccaggacggccaggacgaaccgtttttcattaccgaagagatcgaggcggagatgatcgcggccgggtacgtgttcgagccgcccgcgcacgtctcaaccgtgcggctgcatgaaatcctaggaaatatcagccgcttgtgtgttcaattcttctctgtttcacttgaaacaaattgaatagatattcccgctttcaaagccatttacaaatcctctcgtgcagcctaacgccattggcgtggaacaagcgttggcacgaggaagtaagtgcgatgaacggaaggtattcaccgacgcggcaggattttaagacaggcgcgaagccttggtctatattagcccttatcgttgccgcaatgattttcgcgttcatggcggttgcgtcctggcaggacaatgggactacccaggcaatccttagccaaatacgatcgattaacgctgacagcgcctcactgcagcgcgatgtactccgcgctcacacgggcaccgtggcgaactaccgccccattatctccaggctgggagctctgcggaagaatctggaagatttgaagcaattatttaggcaatctcatattgtaagtgagagcaatgctgctcaactgctacgccggctagaagtgtctctaaattcggctgacgcggcggtcgccgcctttggtgcgcaaaatgtccgcctgcaagattcgctggccagtttcactcgtgctttaagcaatcttccaggaaaggcctcaggcgatcagactttagaaaaaccaacagaattggctagcatgatgctccaatttcttcggcaaccaagcccggctatttcattcgagatcagccttgaactagagaggctccaaaaacaacgcggtcttgatgaagctcccgtgcgcatactttcgcgtgaaggtcccattatcttatcgcttttgccacaggtgaacgatctggtgaacatgattcagacgtctgacaccgcagaaattgcggaaatgttgcagcgtgagtgtttggaggtctatagcttgaaaaatgtggaggagcggagcgcacgtatctttcttgggtccgcttcagtgggtctttgcctgtacatcatcaccttagtctataggctacgcaaaaaaaccgattggttagcgcggcgtttagattacgaagagctaatcaaagagatcggagtatgttttgaaggtgaggcggccactacgtcgtccgcgcaagctgcacttggtattattcagcgcttctttgatgccgatacgtgcgcgttagctctagtggaccatgaccgtaggtgggctgtcgaaacattcggtgcgaagcacccaaaacccgtgtgggacgacagggtgctacgcgaaatagtctctcgtaccaaagcgaacgaacgggcgacggtattccgcatcgtatcgacgcaaaaaatcgtacatttgcctcccgaaattccaggtctttcgatactactggctcacaaatccacagataaactaattgcggtttgttcactgggttaccaaagctatcgccctcgaccttgccaaggcgaaattcagcttcttgaactcgccaccgcctgcctctgtcactatatcgatgttcggcgtaagcagaccgaatgcgacgttttggccagacgattggagcatgcgcaacgccttgaggcagttggtacacttgccggcggaatagcacatgaatttaataacattttggggtcaatcctcgggcacgcagaattggcccaaaactcggtgtctcgaacatctgtcacccgaagatacattgactatatcatttcgtcaggcgacagagccatgctcattatcgatcagatcttgacgctgagccgaaaacaagagcgcgtgatcaagccatttagtgtctcagagcttgtgaccgaaatcgctcccttgctacgtatggctcttcccccaaccatcgagcttagtttcagatttgatcaaatgcagagcgtgatcgaaggaagcccgcttgaacttcaacaggtactaattaacctctgcaagaatgcttcccaagccatgactgcaaatggtcaaatcgacatcttcgtcggccaagcttatttaccagctaagaaaattctggcgcatggtgttatgccacctggcgactatgttctactatctgtcagcgacaatggtggaggcatttcagaggctgtgctaccctacatttttgaacccttctttacgacacgtgctcgcaacggtggaacgggtctcggcctcgcttctgtgcatggtcatatcagcgcgtttgcaggttacatcgacgttagttcaactgttgggcatgggacgcgctttgacatttatctccctccgtcttctaaggagcccgtcaatcccgacagctttttcggccgcaataaggcaccgcgtggaaacggggagattgtggcacttgttgagcccgatgacctcctgcgggaggcgtatgaagacaagatcgccgctctgggatatgagccggtcggttttcgtacctttagtgaaattcgcgattggatttcaaaaggcaatgaagccgatctggtcatggtcgaccaagcgtctcttcctgaagatcaaagtcctaattccgtggatttagtgctcaagaccgcctccatcatcattggcggaaatgatctcaaaatgcccctttcaagggagaatgcgaccagggacctttatctgccgaagccgatatcgtccagaactatggcgcatgcaatcctaaccaaaatcaagacgtagagttgcgacgtatcaggactgggcaatcgcggccgccgggcttacgtgtcttttgtaacaaattgcgacgcagttgatatccacttgaaacattagtccgaaattatcgagatctccgctgataaggtatcgaaatggcgataaaattggtattgatactcgtattcacactctttcccgcggcagacgctgcatatgcgaatgaccgcgccaacggtttcatgtggtcaaacgggggcgaaactggagtgaggcttcctcttcgggtgttcaatgccaagccagccaagaacacggtggcgatcatttattccggagacgctggatggcaaaatatcgatgaggcgattggtacctatctgcagacggaagggattcctgtcattggcgtcagttcacttcggtatttctggtcggagcggtccccaagcgaaactgctaaggatcttggtcacataatcgatgtctacaccaagcatttcggtgtgcagaatgttttacttgtaggatattctttcggcgcggacgtcatgccggcaagcttcaataggcttacgcttgagcaaaaaaatcgggttaagcaaatctctctcttggcattgtcacatcaagtcgactatgtcgtctcatttaggggctggctccaactcgaaacggaaggtaagggcggcaatcctctggatgatctcagatccattgaccctgcaatcgtccaatgcatgtacgggcgcgaagaccgtaataatgcttgcccatctctccgacagaccggcgcagaggtgataggcttcagcggaggccatcactttgataatgatttcaaaaaactgtctacgcgcgtcgtctcaggcctcgtggcacgcctaagtcatcagtaatctttagttcctgcaccgcgggacccgcgaggtttctcgcttcaattgaaatcataaagaagcaattgaaaattttcgagtaaccgaccctcccgataatcttcaacataaaacaacgcacttcttccaacgggagaggcggtgttagttgcgagctaaggagataaggtatgcttaagagatcggggtcgctttctcttgccttgatggtctccttctgttcgtcgagccttgccacgccactctcatctgctgagtttgaccatgttgctcgcaagtgtgccccatcagttgcgacatctacgcttgcggcgatagctaaggtggagagtcgctttgatcctttagcgattcatgacaacacgaccggcgaaacgcttcactggcaagatcacagccaagcaacccaagtcgtcaggcaccgtctcgatgcacggcattcgctggatgttggcctcatgcaaataaactctcgaaatttttctatgctcggtctgacacctgacggtgcgctccaggcgtgcacatcattatctgccgctgcaaacatgctgaaaagtcgttatgcaggcggcgaaacgattgacgagaagcaatttgcgcttcgtcgggcgatctccgcttacaacaccggtaatttcatcggcggttttgcaaacggctacgtgcgaaaagttgaaacagctgctcaatcgctggtgcccgcgttaatcgagcctccaaaagacgatcacgaggcgctaaaatccgaagagacgtgggatgtttgggggtcatatcagcgccgctcgcaggaggatggcgctggcggtttaatcgctccgccaccgccacaccaggacaacggcaaatccgcagacgacaatcaagtcttattcgacttatactaaggaggtgcgcattgatgcgatgctttgagagataccgtttacatctaaatcgcctctcgctctcgaatgcgatgatgcgcgtgatatcgagctgcgccccaagcttgtgcggtgcaattgcatggagcatttcctcatccggacccgccgcagcgcaatctgcgggtggcggcactgaccccgccacaatggttaacaatatatgcacgtttatccttggtccgttcggccagtcactcgctgttctcggcattgtcgctatcgggatctcctggatgttcgggcgggcttcgcttgggctggttgccggcgtcgtcggcggcattgttatcatgtttggggcgagcttcctcggccaaacgctcactggcggtagttgatggctgatcgtttggaagaatcgaccctttacctcgcagccacacggcccgcattgtttcttggggtgccactgacattggcagggttattcatgatgttcgccggctttgtcatcgttatcgttcagaacccgctctacgaagtcgttctcgtgccgttatggtttgcagcccggctcatcgtggagcgagactacaatgcggcgagcgtcgtcctgctatttttgcggaccgcgggaagaagcattgatagtgcagtttgggggggcgctactgttagcccaaatccaattagggttcccccacgagggagaggaatggtgtgatgctcggcgcgagtggaacgaccgaaagatccggtgagatctatctcccttatattggccacctcagcgaccatatcgtccttcttgaagacggatcgatcatgaccattgcgagaattgatggcgttgcattcgagcttgaggaaactgaaatgcgcaatgcgcgttgtcgtgcgttcaacacgctgttgcgcaatatcgctgatgatcatgtgtcaatatatgctcacctcgtacgtcatgccgacgtgccatcatcggcgccgcgacacttccgtagtgttttcgccgctagcctgaacgaagcttttgaacagcgcgtgctctccggccaactcctccgcaatgaacacttccttacgttgattgtctacccacaggcggctttagggaaggtaaagaggaggttcaccaagctaagcggaaaaagggaaaacgatctcacgggccagatcaggaacatggaagatctttggcatgttgtcgctggctctcttaaagcgtatggcctgcatcgtcttggcatccgcgagaagcagggtgtgctcttcaccgaaattggcgaagcgctacggttgatcatgactggtcggttcacaccggttccggtcgtcagcggctcactcggcgcttcgatttataccgacagagtcatttgcggcaagcgaggactcgagatcagaacgccaaaagacagttacgttggatccatctattcgtttcgcgaataccctgcaaaaacacggccgggcatgctcaacgcgctgctatccctcgattttccacttgttctcacgcagagtttttcgttcctgactcgcccgcaagcgcacgcgaaacttagcctcaaatcgagccagatgctgagttccggcgataaagccgtgactcaaatcggcaaattatccgaggctgaggacgcacttgcgagcaacgaattcgttatgggctcacatcatttgagcctttgcgtctatgcagacgatctcaatagtcttggggacaggggcgcgcgggctcggacacgaatggcggatgcaggtgccgtggttgtccaagaaggtattggtatggaagcggcctattggtcccaattgccggggaattttaagtggcgcacacgccctggcgcaatcacttcacgcaatttcgcagggtttgtctctttcgaaaactttccagagggcgccagctcaggccactggggcaacgcgattgcccgatttcgtaccaatggcggaacgcctttcgactatatcccgcatgagcacgatgttggcatgacggcaatattcgggcctatcgggaggggtaagacgacgctcatgatgtttgttctagccatgctcgaacagagcatggtcgaccgtgcaggtacggtcgtgttctttgacaaggaccggggtggcgaattgctggttcgcgccacaggaggaacatatttggcacttcacagaggcacacccagcgggttggcgccgttgcgtggcctagaaaacacagcagcctcacacgattttctgcgcgaatggatcgtggctctcatcgagagtgatggtcggggtgggatttctccggaagagaaccgccgtctggtccgtggtatccatcgtcagctctcgtttgatccacaaatgcgttcaatcgcggggttacgtgaatttttgttgcatgggcccgccgaaggcgcaggagcgcggctccaacgctggtgccggggccatgcgcttggctgggcatttgacggcgaagttgacgaagtaaagttagatccgtcgattaccggcttcgacatgacgcatcttctcgaatacgaggaagtatgcgctcccgctgcagcatatctcctgcatcggattggagccatgatcgacggccgccgttttgtgatgagctgcgatgagtttcgcgcctatttgttaaaccctaaattttcgactgtcgtcgacaaattcctcctgaccgttcgaaaaaacaacgggatgctaatactggcaacgcagcaaccagagcatgttctggaatcgccgctaggagccagcttggttgcgcaatgtatgacgaagattttctatccatcaccaaccgcagatcgatcggcttatgtcgatggactgaaatgtaccgaaaaggaatttcaggcgatccgtgaagacatgacggtcggcagccgtaagtttcttcttaaacgagaaagtggaagcgtcatctgcgaatttgatctgcgggatatgcgtgaatatgtcgccgtgctttcggggcgtgccaacacggtgcgctttgcaactcgactacgcgaggcacaagaaggcaactcatctggctggctcagcgaattcatggcccgtcaccacgaggcagaagattgataaggtaggaaacgatgaagacgacgcaacttattgcaacagttttgacctgcagctttctatatattcagcccgcgcgggcgcagtttgttgttagcgacccggcaacggaggctgagacgctcgcgactgcgctcgcgactgcggagaatctcactcagactatagcgatggttacgatgttgacgtcggcctacggcgttactggactactgacttcgctcaaccagaaaaatcagtatccttcgacgaaggacctagacaatgaaatgttttcgccgcgaatgccaatgtcgaccacggcacgtgcgatcaccagcgatacagatcgtgcagtcgtgggtagtgatgctgaagcggacctgttgcgatcgcagatcaccggttccgcaaacagcgctggcattgcggctgacaatctggaaacgatggacaaacgcttgacggcgaatgctgatacgtctgctcagctttcccgatctcgcaatatcatgcaggcaaccgtgaccaatggtttgcttctcaagcagatccatgacgcaatgattcaaaatgtacaggcgacaagcctattaacgatgactaccgcgcaggccggccttcacgaggcggaagaggcggccgctcaacgcaaggagcatcaaaagaccgctgtcatctttggtgccctcccctaaggctgggcgatttgttcatccgcccgcatcctcgccgaatgcgagctcattttatccaacattatgcgacaaaccagtcaagttcaggtccaatcgatgaatttcacgattccggcgccgtttacggccattcatacgatcttcgatgtagccttcacgacaggcttggactcgatgcttgagactatccaggaggcggtgagtgcgccattgatcgcctgtgtcactctttggattattgttcagggtattttagtcatacgcggcgaagtcgatacccgtagcggtatcactcgggtgatcacggtcaccatcgttgttgctctaattgttgggcaggctaactaccaagactatgtggtttccatcttcgaaaagacggtcccaaactttgttcagcagtttagtgtaaccggcttgcctctgcagactgttccggcacagttggatacaatgttcgccgtgacccaggccgtttttcagaaaatcgcatccgaaatcggtccgatgaacgaccaggacatccttgctttccaaggggcacagtgggtcctttacggcacgctctggtctgccttcggagtttacgacgccgttggaattctcacgaaagtgcttctcgcgatcgggcctctgatcctcgtcggatatatttttgatcgcacgcgggacatcgcagctaagtggatcgggcaacttatcacctacggtctcttgcttctcctcttaaacctcgtggcaacgatcgtcatcctaaccgaagcgactgcgctcacccttatgcttggtgtaatcaccttcgccggtacgaccgcggccaagatcattggtctttacgaactcgatatgttttttctgacaggggatgcgctcattgtcgctttgccggcgatcgccggcaacattggaggcagttactggagcggcgcaacccaatctgccagcagcttgtaccgtcgcttcgctcaggttgagcgaggctaggtcgcgcaaaaattcgcctcaatggagaattctatgaagtattgcctgctgtgcctagttgtcgctttgagcggctgccagacaaacgacacattagcgagctgcaaaggcccgatcttcccgctgaatgtggggcgatggcagcctactccgtcagatcttcagctcggcaattcgggtggacgctatgacggggcctgaatatgccatgctagtggcgcgcgaaagccttgccgagcactataaggaagtagaagcctttcaaaccgcgcgagcgaaatcggcgcgacgtctctccaaactcattgcagctgtcgcagctatcgcgattttgggaaatgttgctcaagcgttcgctatagccacaatggtgccgttgagcaggcttgtgcccgtatatctatggatacggccggacggcaccgttgacagcgaggtgtctgtctcgcgattgcctgcaactcaagaggaggccgtcgttaacgcctcattgtgggagtacgttcgcctgcgcgagagttatgatgccgacaccgctcagtacgcctacgacctggtatcgaacttcagtgccccaacagtgcgccaggattaccagcaattcttcaactatcccaatcccagttcgcctcaagtcattcttggcaaacgcggcagggtggaggtcgagcacatcgcttcaaatgatgtaactccaagcacgcagcaaattcgctataaaaggaccctcgtcgttgacggcaaaatgcctgtggtgagtacgtggaccgcgacagttcgctacgaaaaggtgaccagcttgcccggcagattgagactaaccaacccggcaggtctggttgtcacctcctatcagacatcggaagataccgtttcaaacgtaggccacagcgaaccatgatcagaaaagcacttttcattttagcatgtttatttgccgctgcgactggtgcggaggctgaagacactccaatggcgggcaagctagatccgcgcatgcgttatttggcttacaatcccgatcaagtggtgcgcctctcgacggcggttggagctactttggtcgtaacattcgccacgaacgaaacggtgacagcggttgccgtttcaaatagcaaagatctagcagccctaccgcggggaaattatctatttttcaaggcaagccaggtcctcacgcctcagccagtaatcgtgctaaccgcaagcgactccgggatgcgccgttatgttttcagtataagttccaagactctgtcccacctcgataaagagcagcccgatctctattacagcgtccaattcgcctaccccgccgacgatgcggcggctcggcgaagggaggcacaacagaaggctgttgtggacagactacacgcggaagcacaatatcaacggaaagctgagaatttattggatcagcctgtcacagcccttggtgcggcggacagtaattggcactacgtcgcccaaggcgatcgttcgctgttgccactcgaagtcttcgacaatggatttacgacggtattccactttccgggcaatgtacgcataccctccatctacaccatcaatcctgatggcaaggaagctgttgccaactattcagttaaagggagcgatgtcgagatttcttcggtttcccgaggttggcgtctgagggatggccacacagtactatgtatctggaacaccgcttacgatcccgttggccaaaggccgcaaacgggcacggtgaggcccgatgtgaaacgcgtcctgaagggggcgaagggatgaataacgatagtcagcaagcggcacatgaggttgatgcatctggatccctggtctccgacaaacatcgccggcgtctttcggggtctcagaaattgatcgtcggaggtgtcgttctcgcgttatcattaagcctcatttggctaggtgggcgccaaaagaaggtgaatgagaacgcatcgccgtcaactttgatcgcaacaaacaccaagccatttcatccagctccgattgaggtgccgccggatcctccagcggttcaagaggctgttcagcctgctgctcctctaccgccgaggggcgaaccggagcggcatgagccacggccggaagaaacaccgatttttgcatatagcagcggcgatcaaggggtcagcaaacgcgccattcagggcgacacgggccgaagacaagaaggcaagcgtgacgacaactccttgccgaatggcgaagtgtccggcgagaacgatttgtcgatacgtatgaaacccaccgagctgcagcccagcagcgccacgctcttgccgcaccccgattttatggtaacgcaagggacaataattccgtgcatcttgcaaaccgcaatcgacacaaatttggcaggctatgtaaagtgtgtcttgcctcaggatattcgtggaacaacgaacaatatcgtgcttcttgatcgtggcaccaccgttgttggcgaaatacagcgtggcttgcaacagggagatgggcgcgtttttgtgttgtgggatcgcgccgagacacctgaccatgcgatgatctcgttaacatcgccaagcgcggacgaactcggtcgctcaggattgccgggctcggtcgacagccacttctggcagcgttttagcggagctatgctcttgagtgttgttcaaggcgccttccaggcagctagcacctacgccggcagctcgggtggcgggatgagcttcaacagctttcaaaataacggtgagcagacaactgagacagcccttaaggcaaccatcaacataccgccaaccctgaagaagaatcagggtgacaccgtttccattttcgtagcacgggacctcgatttctttggtgtttaccagctccgcctgactggcggcgccacgcgggggaggaaccgccgctcttaatgaattcaaatttccgcttagagataggatacattgtaaatggaagtggatccgcaactacgctttcttctgaagccgattttggaatggctcgatgacccgaagactgaagaaattgcgatcaatcgacctggagaggcatttgtgcgccaagccggcatttttaccaagatgcctttgcccgtctcttatgatgatcttgaagatatcgctattttagcgggcgcgctgagaaagcaggatgtcggaccacgtaaccccctctgcgccactgaacttcctggtggtgaacgactacaaatctgtctgccgccgaccgttccctcgggcaccgtcagcttgaccattcgacggccaagctcgcgtgtttctggtcttaaagaagtctcctcccgttatgatgcttcgaggtggaaccagtggcagacacgaaggaaacgccaaaatcaggatgatgaagctatccttcagcattttgacaacggggatttggaagcgtttctgcacgcatgcgtcgtcagccgactgacgatgttgctatgtggccctaccggaagcggcaagacaacaatgagcaagaccttgatcagcgccatccccccccaggaaaggctaatcaccatagaagatacgctcgaactcgtcattccacacgataatcatgttagactactctactccaagaacggtgctgggctgggtgctgtgagcgccgagcacttgctccaagcaagtctgcgtatgcggccggaccggatattgcttggcgagatgcgcgacgatgcagcatgggcttatctgagtgaagtcgtctcgggacatccgggatcgatttcaacaatacacggcgcgaatccaatccaaggattcaagaaactgttttcccttgtcaaaagtagcgcccaaggtgctagcttggaagatcgcacactgattgacatgctctctacggcgatcgatgtcatcattccattccgtgcctatgaggacgtttatgaagtaggcgagatctggctcgcggcggacgcacgacgccggggcgagaccataggcgatctccttaatcaatagtagctgtaacctcgaagcgtttcacttgtaacaacgattgagaacttttgtcataaaattgaaatacttggttcgcattttcgtcatccgcggtcagccgcaattctgacgaactgcccatttagctggagatgattgtacatccttcacgtgaaaatttctcaagcgctgtgaacaagggttcagattttagattgagaggtgagccgttgaaacacgttcttcttatcgatgacgatgtcgctatgcggcatcttattatcgaataccttacgatccacgccttcaaagtgaccgcggtagccgacagcacccagttcactagagtactctcttccgcgacggtcgatgtcgtggttgttgatctaaatttaggtcgtgaagatgggcttgagatcgttcgaaatctggcggcaaagtctgatattccaatcataattatcagtggcgaccgccttgaggagacggataaagttgttgcactcgagctaggagcaagtgattttatcgctaagccgtttagtacgagagagtttcttgcacgcattcgggttgccttgcgcgtgcgccccaacgttgtccgctccaaagaccgacggtctttttgttttactgactggacacttaatctcaggcaacgtcgcttgatgtccgaagctggcggtgaggtgaaacttacggcaggtgagttcaatcttctcctcgcgtttttagagaaaccccgcgacgttctatcgcgcgagcaacttctcattgccagtcgagtacgcgacgaggaggtttacgacaggagtatagatgttctcattttgcggctgcgccgcaaacttgaggcggatccgtcaagccctcaactgataaaaacagcaagaggtgccggttatttctttgacgcggacgtgcaggtttcgcacggggggacgatggcagcctgagccaattgcatttgattaatttaggtgactgaggacgcggccagcggcctcaaacctacactcaatatttggtgaggggttccgataggtccctcttcaccaattgctcgatggcttctctccagcaaagaatgacgcgagcgcggcggtagccagcttgtggccgaaagctcgagcggtctccaaccccaacggatcaaaatgacttcgagcgacctcgagcaacgcaaccgggaacatgcgtgaggtctgaacgagaacggatttttctgtagttgaagggatcggataacttttcggggccacgcgaaatgatccatctgccagcatgctttcgaaatcgtccaacgcgcgccttaaaatcatttgtagcgacttcgagggactgtattgccgaacgaggttgtcatatgttttcgacacttgaggcgcgggcggtcgcgctgaaagaaaaacctggagctttttcggggacggaggtggactaagggcatccacagttagcttaagttgtcgatcgggactgtaaatgtgatcggcgacgagaggctcacgttgctggtctttctcgtcggctttttcaggcaagtgctggaggtccagcttctggggaacaagtgtcgggttgggatggtggatctcgggtcgagcaccagcaagccgccgtgcttcgccgaccgacaatgcgggcttgcgaattgccatcttcaagcctccaagattttgctgatcagtttcgaaatgaccacgacttcctccatcgcaatccgaagattcctctctatgaggcgcatcgtcggatcagttcccgtgtttagtaatgtaagatgcaacatgccgcgttctttcatcgcggcaaatgcatctctttcatgcatgggagacggtacaactggaaggctctctagcgtctctgacatcctgcgttgcgatgttgtcaatcggccgaccgggacgcgttggcgcaaaacagctgtaggaattgccaaattttcactcaacagcagctcgatgacgtagcggtaggtagatagtgcctcatcgatgtcgagcggcgttagcatggtggggatcagaagcaggtttgagctagcgatgattgtgttgttgagctcgctcgagccgccacgcgtatcggccaacgcataatcaaatccttcgagctcggcattttcataggctgcttcaagaaggggcatttcgtcggcggaatagacttcacagcgaggatcccaggtactgctttgtaaggcgttttctctccatcgcgtcagaggccggttttcgtcggcatcaaagagggccactcgtttaccgtcatttgccaaagcagcgcaaaggcccatgagtgcggtggttttgccagcaccccctttgaaagaacaaaacgtcaaaagttgcatattctgatcccgcctatcctgtgaaaccggagtgcatttgtatttttgttcgtataaatgtttttgtgattatcgatgagtaaaagcgttgttacactatttttatttcacattcgttataagacaattgcaaatgtagcaagtatattcagtattgactgtaaatgtactgttgatttcatattgagcagggctagacttccatccgtctacccgggcacatttcgtgctggagtatccagaccttccgctttctttggaggaagctatgtcaaaacacaccagagccacgtcgagtgagactaccatcaaccagcatcgatccctgaaagttgaagggttcaaggtcgtgagtgcccgtctgcgatcggccgagtatgaaaccttttcctatcaagcgcgcctgctgggactttcggatagtatggcaattcgcgttgcggtgcgccgcatcgggggctttctcgaaatagatgcagacacacgagaaaagatggaagccatacttcagtccatcggaatactctcaagcaatgtatccatgcttctatctgcctacgccgaagaccctcgatcggatctggaggctgtgcgagatgaacgtattgcttttggcgaggctttcgccgccctcgatggactactgcgctccattttgtccgtatcccggcgacggatcgacggtcgctcgttactgaaaggtgccttgtagcacttgaccacgcacctgacgggagaaaattggatgcccgatcgcgctcaagtaatcattcgcattgtgccaggaggtggaaccaagacccttcagcagataatcaatcagctggagtacctgtcccgaaagggaaagctggaactgcagcgttcagcccggcatctcgatattcccgttccgccggatcaaatccgtgagcttgcccaaagctgggttacggaggccgggatttatgacgaaagtcagtcagacgatgacaggcaacaagacttaacaacacacattattgtaagcttccccgcaggtaccgaccaaaccgcagcttatgaagcaagccgggaatgggcagccgagatgtttgggtcaggatacgggggtggccgctataactatctgacagcctaccacgtcgaccgcgatcatccacatttacatgtcgtggtcaatcgtcgggaacttctggggcaggggtggctgaaaatatccaggcgccatccccagctgaattatgacggcttacggaaaaagatggcagagatttcacttcgtcacggcatagtcctggatgcgacttcgcgagcagaaaggggaatagcagagcgaccaatcacatatgctgaatatcgacgccttgagcggatgcaggctcaaaagattcaattcgaagatacagattttgatgagacctcgcctgaggaagatcgtcgggacctcagtcaatcgttcgatccatttcgatcggacgcatctgccggcgaaccggaccgtgcaacccgacatgacaaacaaccgcttgaaccgcacgcccgtttccaggagcccgccggctccagcatcaaagccgacgcacggatccgcgtaccattggagagcgagcggggtgcccaaccatccgcgtccaaaatccctgtaactgggcatttcgggattgagacttcgtatgtcgctgaagccagcgtgcccaaacaaagcggcaattccgatacttctcgcccggtgactgacgttgccatgcacacagtcgagcgccagcagcgatcaaaacgacgtcatgacgaggaggcaggtccgagcggagcaaaccgtaaaagattgaaggccgcgcaagttgattccgaggcaaatgtcggtgagcccgacggtcgcgatgacagcaacaaggcggctgatccggtgtctgcttccatccgtaccgagcaaccggaagcttctccaacgtgtccgcgtgaccgtcacgatggagaattgggagaacgcaaacgtgcaagaggtaatcgtcgcgacgatgggcgcggggggacctagactagtagacaggaaggaccgaataatggcaaatggtcagttcacgatacgctctgctcgcccggcctccgtcggactgacaggcgaacggcgtggagccgcatccgcctctagctctgcactgtccaatgttcaaagagatgttagggataggctgattccaactagctcaccaagattaccaaatgcagccatattgcgtgattcctcgggaagagcgtcgactggtctgcggtacatggcggctactcttcattggtctgcgatcgcgccattatcgctaataaacagcaacgacctggctccggccgcttatgactttgagacgcgaaataacgcaagaaatgtgactgccaaagtcggcagggcagtccctgttcccaagcaaggcgggctcggcaaaacgctcgcacccgtaccccttagtacacgtatatcaagggtcaattccgaccgaagactgcccgctgacgcagaagaccgccctgaaacgcgcgacccccagaaaggacgtggcagtcatggtgcgacgccaaccttacatgaaaagattggaaccgcgtttgctcgaagattgcgaaagcatacgtactatattgtttgcagttgctgccagacccggagcgcgttgacgatgggtgcaaagatttcggtgaagtcatgaactccagcaagacttcgccccagcgtatgaccctgagcatcgtatgttcgctggcagccggtttttgtgcggccagctgctatgtaacgttccgccggggcttcaacggcgaagcgatgatgacgttcgacgttttcgctttttggtatgagaccccgctttacttgggttatgccagcaccgtcttctggcgtggtttatctgttgtcatctttacctcgctgatcgttctttcaagtcagctcatcatatcgctgcgcaatcagaagcatcatgggacagctcgttgggcagaaattggcgaaatgcggcatgctggttatctgcagcgttacagtcgcatcaaggggccgatctttggaaagacatgtggtcccctttggttcggcagttatttgaccaatggcgaacagccacacagtcttgtcgtcgcgccaacgcgtgctggcaaaggcgtcggcatcgtcattccaacgctgttgaccttcaagggctcggtaatcgcccttgacgtcaagggagaattgtttgaactgacgtccagagcacgcaaagcgagcggcgacgcagttttcaagttctcccccctagatcctgagcggaagactcattgttacaatccggtcctggatattgccgcacttccgcccgaacgccagttcactgaaacacgccgtctagctgcgaaccttattacggctaagggaaagggagcagaaggctttattgacggcgcacgtgacctgttcgtcgcgggaatccttacctgcattgagcgtggcacaccaacgattggcgcggtatatgacctatttgcgcagcctggcgaaaagtataagctttttgcgcaactcgcggaggaaagcctaaacaaagaggctcagcgtatcttcgataatatggcgggcaacgacacgaaaattctgacatcgtacacctctgtgctgggcgacggtggactgaacctgtgggctgatccgcttatcaaagcagcgacaagccggtcagacttttccgtttacgatctccggaggaagaagacctgcatttatctttgtgtcagtcccaacgatctggaggtcttggcaccacttatgcgcctgatgtttcagcagctcgtgtcaatcttgcagagatcgctgccaggtgaagacgagtgccatgaagttttatttctcctcgacgaattcaaacacctgggcaagcttgaggccatagagaccgcgatcacaaccatcgccggttacagaggccgctttatgtttattattcaaagtctttcggccttgtcgggcacatacgatgacgcaggaaaacaaaactttctgagcaatactggcgtacaagtatttatggccacggctgatgacgaaactccaacctacatctcaaaagctatcggcgaatatacgtttaaagcgcgttcgacctcttacagtcaagccagaatgttcgaccacaacatccagatttctgatcaaggtgcagcccttttgcgccccgaacaagtgcgcctgctagacgatcagagtgaaatcgttctcatcaaagggcgacctccactcaaattacgaaaggtgcagtattattccgatcgtacgctgaaaggccttttcgaacgccagatgggctctctgcctgagcccgcacccttgatgctttccgactatagcaacgatcaagttcaataccacttggctccgatagcaaattttaatgaggatgctgcaccgcaaaacagaactgtggccgaggaccatggaagtgttaaagtcggtgctgatatccctgaacgcgtgatgggaataaatggtgacgaggaacaagccgatgcgggcgagataccgccggaatcggttgtgcctccagaattgacgctcgctctgaccgctcaacagcaattgttggaccagattattgcacttcagcaaagatcgaggtccgcaccggcatagcctgcgaaatgatcttaatggtgcaattcgtttcaggcggcatgttgcggttcaacaaagtgtacgccagatcccaattggccctttacgaggtgtcggtatgacaggaaagtcgaaagttcacataagaggttcggctgacgcgcttcctgacgttcctggcggaagtactaccgccccttttttaaccgaaccttctcgggatcaggttgatgcctcgtttgaggtccaaaccgactacagccagtctacttccgtgtcgtttacctatgatggtgttggacttggtcctgccgagcgtgcggcttacgagaactggtgcgaaccgggccggcccacttggaaagatcttataatcaaggcacgtgtcgatccgattgacgatgtgacctggctccgagatttagaagaggacaccccctcaaccttcagatacgaagggatgcctctgggcatcggggaacgacaggcctacgaaaattggcaagaggacgctcagccgacatgggaagaccttgttgtcagcgcacgcttgacggaacttggccgtccacacgggattaccggcgagtatacatccctcgcaggatcgaagaatacaagttcaatttcattgaagcgaaagcggagcaacttaattgatgatgagaattcatccggatcgttttcatatgacgggatgaagctcggggaagccgagcgttctgcatatggtgactgggccgaggcggagccacccacgtggaaagatttggtattgagggcacgcgtttcctcgatcaatgactctgcttggctttttgattcacaaacatcttcatcatcatttgaatacaacggtgttcccttgggcgagccggaacggcaggctctcagacaatggcaaggagacgctcagcctacctgggaagatctcgttgttaacgcgcgtatggcagaactttgccatgctggttggattgaaggtcaaaaaggttgctttgaagagcgcggggaggctctgcccgcgtcggaacgcggttcgcaacgccccattggtcaacggacagattcctccgattcttttgtgtatgatggcacaaggctcggagcacctgagcgaactgcttatgaacgctggagtaagagggaacgcccgacttgggaagatctcatcttagatgcacaccaggccaggactgaaagtgacgctgttacgacccaagcgattggtcagtcgtcctcaccggttttcttatatgaaggaaagtcgctcggagacagggaacgaaaggcttacgaaaaatggcggcagccagcccaaccgcgatggcaaaatcttgtagtgaacgctcgtctggcagaaatcgatccctcagcctggattgccgatgagcgcgatccgcttgatgatagcgacgcgcttggtcgcccgtcgtacacaagcttgacggatagatcagacgtccctttagacgatcaatcaatctatcgtcgttccgacctagtaagggagcaggtgccagaatcgtctcaaaggcaattcgcagcatgttcagaatctgaaacgaggcctgtgcaatggtttactgcttctgggtcagatgcaaacaatacggaaaatatcaccgccagcgatcccgtcgatcgcacgggtggagttaagcggctaggctccaaaagcgacagaaccgttacagcttctatccatgacgtgaattccagcacaaggcgactgttgcttaacgaatttggatcggaggctccgcgcccttcgccagaaaagactgttcgcttaagaagcgacaatattggcacctatgggagccggaaaaatgaacgagcgcggctcgcgaccgaaaccggtgcgtatgagtcggagcatattttcgggttcaaggctgtccacgatactgcgagagcgacgaaagagggccggcgtctcgaaaggcccatgcccgcctaccttgaggataaggggcttcatcgccaacatattggcaccgggagaggacggaccaaacttgtcgggcgcggatggccggatgacacaagctatcgctcggatcaaagggcaactctgtcggaccccgttgcgcgctcggaaggcgcgacggcctcaaatgggtatcaattgaaccaattgggttacgcgcaccaactcgctagcgatggcctgcaaagtgaatcgcccgatggtgttgccttgccaattcaagtggcaacaacgagctacaactatacagtgagccgcgatcctgtccttgttccgccggataaaaacgaagcccctcaattgctgcatcttggtccccgtggtcaaaccgaagctgttcttgcccgcgaaacagcattgactggaaaatggccgactctcgagcgtgagcagcaagtgtatcgcgagtttttggccttatatgacgtaaaaaaagatcttgaggccaaatcagtcggcgtaagacggaaaaaaaaagaagttatttctgcgttagaccgaactgcgcgcttgataagcacgtcgccttcgaaagctcgatccaaagcagagactgaaaaagccattgatgagctcgatgatcgacgagtttatgatccgcgtgatcgagctcaagacaaagcgtttaaacgctgataagtcgccaatatagtgatcatttgcagtattcgcatcgatcgctggttgatattctgccgctggtcgaccggctgctcgtcgccaaaaatgctcacagggatacgatggcctcggtcaggccgcgtgcgtcctgtctttccagttcctccctttcagctcgattgtggcatcatttattgcctgctcattgcagttgaaacgcgatatccgtttcaagacccgggtatggatggtactttggagatatgagcacttgccagacttcccggtcggagacttaaaaattccgataagaggttacggacgacggaccttataagtggatcgtctagtggtggcgccgatcaaaacagttccgcccccggctttgctcaaagtagcaaagcagctttatctcgggttgcggaggattttctagaaaaccgcaattttgcaggagagaacatatggccatcatcaagccgcatgtgaacaaaaataggacaacctcgccgatagagagaccggagtctctcatagaggaaatgagcggcagtcatccgccgagtggttttaccaacctggatctcgctatgatcgagctggaggactttgtccatcggtgcccgctcccagaagacaatcttgctggtcagaaggagtgagacgatggatccgtctagcaatgagaatgtctatgtgggtcgcggtcacaacatcgaaaatgatgatgacactgaccccaggcgttggaagaaggcgaatatcagttccaacaccatctccgatattcagatgacgaatggcgaagacgtacaatcagggagccctacccgaacggaagttgtaagcccacgtctggattatggatcggtcgactcctcctccagcctttattctggcagcgagcacggaaatcaagctgagattcaaaaagagctgtccgtcttgttctcgaacatgtctttgccaggcaacgatcggcgcccggacgaatacattctcgtgcatcaaacgggacaagatgcttttactggtattgccaaaggcaacctcgaccaaatgcccaccaaggcggaatttaacgcgtgctgccgtctctacagggacggagccggtaattactacccgccacctctcgcattcgacaagattagcgttccagagcaactggaggaaaaatgggggatgatggaggcgaaggaacgtaacaaactgcggtttcagtacaagttggacgtatggaatcatgcgcacgctgatatggggatcacgggcacagagatcttttatcaaacagataagaacataaagctcgaccggaattataaactaagacctgaagaccgatacgtacaaacagaaaaatacgggcgccgggaaattcaaaagcgatatcaacacgaactccaggctggttcgctgctgcccgatattatgatcaaaactccccaaaatgacatccacttcgtgtacaggtttgccggcgacaattacgccaacaaacagttcagcgagtttgaacacaccgtcaagcgcaggtatggcgacgagactgagatcaaattgaagtcaaagtcaggcattatgcatgactcgaaatatctggaatcctgggaacggggcagtgcggatattcgcttcgcggaattcgttggggaaaatagagctcacaatcggcagtttccaactgcgacagtaaatatgggacagcagccagacgggcagggcggtttgacccgcgaccgtcatgtgagcgttgacttcctaatgcaaagcgcacccaattcgccttgggcgcaagctttgaaaaagggagaactgtgggatcgcgttcagttgcttgctcgcgacggcaaccgctatctgtcgccgcccagattggaatattctgaccctgcacatttcaccgagttgatgaaccgggttggtttacccgcatcgatgggtcggcaaagccatgcggctagtatcaaattcgaaaagtttgacgcgcaggcagcggttattgtcttaaatggcccagagttacgtgacattcatgacttgtctcctgaaaaactgcaaaatttgtccaccaaagatgtcatcgtcgccgatcgcaatgagaatggtcagagaactggcacgtacaccagcgtcgcggaatatgagcgcttgcagttaaggctgccacccgatgcagcgggggtgcttggtgaagcaactgacaaatattcacgtgatttcgttcggccagagccggcgtcgcgtccaatcagtgacagccgcaggatatacgaaagtcgaccgcgtagccaaagcgtcaacagcttttgacgttcctgctgccgcgtcaacgaggaagctcgtttgacccgggtttgccaatgaaagggctcaatcatggtgaacactacaaagaaaagttttgcgaagtcgcttacggcagatatgcgccgttctgctcagcgcgttgtcgagcaaatgcgaaaagcattgattaccgaagaagaggcgctcaagcggcaagccagactggagagtcccgataggaagcgaaagtatgctgctgatatggcgatagtcgacaaactcgacgtagggtttcgaggcgaaataggctataaaattcttggaaataaccggcttcgagtagacaaccataaagaattaacgcgtgagcacggtagacttcgcaaaaccaaaacggttctgaagcgtaacccggtgacgcaggaagtctatttgggtttatatgaaaggaagtcctggttaagtgtcagcagccatttgtatgctgcggacggcacactccgcatgaagcacgtgaaatacaaagacggacgttttgaggaaaaatgggagcgcgacgaaaatggcgacctgatccgcacaaggtacgccaaccgtggcaggctctttcaacctgtatccgagaaaatgggcgcgccgtatcggagcggccctgacgaccggctctatcgcgatctaacccgtcgaaacggtttcagacgggagacattcgaacgggacgatcacggaaacctcgagcgtatcggcagcaaccatgtcggcttttccaagatttcagtgaaggcacccaatcgtcaaacctcccagacgaagattcaaaaacttggtggcgctttcaacaaatcttttaggtcccttctggacaaggagggcaatgaaatgggccgcgatattttgagccatcgacggctctataacaagcggtctgctgtctacgatgaagctaccggacaattgaagagtgccaagcataccttcggcaagatctacaggagcgaaaccgaatatctcagcgcgggcctcaagaaggtttcaaaaaagatactcggggtgacggtctaccggaaatttgcggcgctcagcgagcgagaatccgaggctgagagactgcgtagttttgaatccggtgcgcatcgccagatctggcaggagcgggcagcgattcccggttcgcccctcccggagactgatgacattcatttcgcacagcagtcgcacctagccaaagccaaccctgatcacgtcgaagctgacgtcacgcgtgtgacagatcaacatgttgatgttgctggacaaacatcatcgtctccccaacggaacttggaaggatggttagattctcaatcacgatacaagccagcaaacatgctgttgtcaaatccagaccttcaagcgaacggacctcgcccatacgaagggttagctcatctcaccctccggcgcgataatgaatctgacgggcacaaggagaatgatcagcggctgcgacatttctcccagccagagccgttggtgttaccgcatcccgggtcgccggaaataactaaggtgtttggctcgcggggagagccggcacacccgagtggaaatctgcacacggcggttggagaaacggcttgcgaaggaccggtgatgtcttcatcctcggacaatcatcagccagctccaggacagcaagaacttttaagtttccttcataatgcgccagccccagtttctgtggcaatacatgatgatcaagagcgacttgcgggggaggcgcccggcggctctttcagaggtagctcagggcgaacgagttcaatgtcggagagtatcttcgacgaagatgtacaagggcatttggtacgggattattcgatcaatactactaacgggtttattgacccgcaatcgttgttcggtgaaccggacttatcgagaggtccaaaatcggggccagaaattccatcggaagattaccatttgtcagcttcggaacaggaaaatttgctgaatcaattgcttagtgtgccactgccggttccttcaccgaagcccgaatgcgcgaggtctatgattttcgaaggttcacgttcaagagagcgttccacctccagagggttctaaggtggaacgcgtctaggcttgcctatcatcaccacctcatgatggtcgcggagaccttcgaagagatatccgacatcattggagaagctgggccggaaactagtgtacctcgcgaatgcatctagatccaatccaatatgcatggcatgccgaatccatgtgggagtttattcttgacacagatatttatgatataataactgagtaagcttaacataaggaggaaaaacatatgttacgcagcagcaacgatgttacgcagcagggcagtcgccctaaaacaaagttaggtggctcaagtatgggcatcattcgcacatgtaggctcggccctgaccaagtcaaatccatgcgggctgctcttgatcttttcggtcgtgagttcggagacgtagccacctactcccaacatcagccggactccgattacctcgggaacttgctccgtagtaagacattcatcgcgcttgctgccttcgaccaagaagcggttgttggcgctctcgcggcttacgttctgcccaagtttgagcagccgcgtagtgagatctatatctatgatctcgcagtctccggcgagcaccggaggcagggcattgccaccgcgctcatcaatctcctcaagcatgaggccaacgcgcttggtgcttatgtgatctacgtgcaagcagattacggtgacgatcccgcagtggctctctatacaaagttgggcatacgggaagaagtgatgcactttgatatcgacccaagtaccgccacctaataatgtctaacaattcgttcaagccgacgccgcttcgcggcgcggcttaactcaagcgttagatgcactatacgtaccaatccaaatcggatccccctgcagggctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagcagatctatcgatggtacctatctgcagacggaagggattcctgttaattaaaacagcttgcgtcatgcggtcgctgcgtatatgatgcgatgagtaaataaacaaatacgcaaggggaacgcatgaaggttatcgctgtacttaaccagaaaggcgggtcaggcaagacgaccatcgcaacccatctagcccgcgccctgcaactcgccggggccgatgttctgttagtcgattccgatccccagggcagtgcccgcgattgggcggccgtgcgggaagatcaaccgctaaccgttgtcggcatcgaccgcccgacgattgaccgcgacgtgaaggccatcggccggcgcgacttcgtagtgatcgacggagcgccccaggcggcggacttggctgtgtccgcgatcaaggcagccgacttcgtgctgattccggtgcagccaagcccttacgacatatgggccaccgccgacctggtggagctggttaagcagcgcattgaggtcacggatggaaggctacaagcggcctttgtcgtgtcgcgggcgatcaaaggcacgcgcatcggcggtgaggttgccgaggcgctggccgggtacgagctgcccattcttgagtcccgtatcacgcagcgcgtgagctacccaggcactgccgccgccggcacaaccgttcttgaatcagaacccgagggcgacgctgcccgcgaggtccaggcgctggccgctgaaattaaatcaaaactcatttgagttaatgaggtaaagagaaaatgagcaaaagcacaaacacgctaagtgccggccgtccgagcgcacgcagcagcaaggctgcaacgttggccagcctcgcagacacgccagccatgaagcgggtcaactttcagttgccggcggaggatcacaccaagctgaagatgtacgcggtacgccaaggcaagaccattaccgagctgctatctgaatacatcgcgcagctaccagagtaaatgagcaaatgaataaatgagtagatgaattttagcggctaaaggaggcggcatggaaaatcaagaacaaccaggcaccgacgccgtggaatgccccatgtgtggaggaacgggcggttggccaggcgtaagcggctgggttgcctgccggccctgcaatggcactggaacccccaagcccgaggaatcggcgtgagcggtcgcaaaccatccggcccggtacaaatcggcgcggcgctgggtgatgacctggtggagaagttgaaggcagcgcaggccgcccagcggcaacgcatcgaggcagaagcacgccccggtgaatcgtggcaagcagccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggcaggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctagctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagccgaagagctgcaaaaagcgcctacccttcggtcgctgcgctccctacgccccgccgcttcgcgtcggcctatgcatataattgtggtttcaaaatcggctccgtcgatactatgttatacgccaactctgaaaacaactttgaaaaagctgttttctggtatttaaattaaaaatgaagcgtacgttggaatcgcttctacaaaactcacagaaacaatcaaacaaacatacacagcgatttattcacacgaacccgaattacaacggtatatatcctgtcagccaacaccaaaacatcaaaaaaatcgggatcaggatcaggatctgcggccgcatcctgcaggtcgactctagaggatcctcatcgctatcaactttgtatagaaaagttgggccgaattcgagctcggtacggccagaatccggtaagtgactagatcccccaattcgtcaacttcgtccacagacatcaacatcttatcgtcctttgaagataagataataatgttgaagataagagtgggagcccccactaaaacattgctttgtcaaaagctaaaaaagatgatgcccgacagccacttgtgtgaagcatgagaagccggtccctccactaagaaaattagtgaagcatcttccagtggtccctccactcacagctcaatcagtgagcaacaggacgaaggaaatgacgtaagccatgacgtctaatcccaacttcgtccacagacatcaacatcttatcgtcctttgaagataagataataatgttgaagataagagtgggagccaccactaaaacattgctttgtcaaaagctaaaaaagatgatgcccgacagccacttgtgtgaagcatgagaagccggtccctccactaagaaaattagtgaagcatcttccagtggtccctccactcacagctcaatcagtgagcaacaggacgaaggaaatgacgtaagccatgacgtctaatcccacaagaatttccttatataaggaacacaaatcagaaggaagagatcaatcgaaatcaaaatcggaatcgaaatcaaaatcggaatcgaaatctctcatctaagagctcaaaaaaaaaaaaaaccatggcctcctccgagaacgtcatcaccgagttcatgcgcttcaaggtgcgcatggagggcaccgtgaacggccacgagttcgagatcgagggcgagggcgagggccgcccctacgagggccacaacaccgtgaagctgaaggtgaccaagggcggccccctgcccttcgcctgggacatcctgtccccccagttccagtacggctccaaggtgtacgtgaagcaccccgccgacatccccgactacaagaagctgtccttccccgagggcttcaagtgggagcgcgtgatgaacttcgaggacggcggcgtggcgaccgtgacccaggactcctccctgcaggacggctgcttcatctacaaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcaggtgaagttcatcggcgtgaacttcccctccgacggccccgtgatgcagaagaagaccatgggctgggaggcctccaccgagcgcctgtacccccgcgacggcgtgctgaagggcgagacccacaaggccctgaagctgaaggacggcggccactacctggtggagttcaagtccatctacatggccaagaagcccgtgcagctgcccggctactactacgtggacgccaagctggacatcacctcccacaacgaggactacaccatcgtggagcagtacgagcgcaccgagggccgccaccacctgttcctgtagcggccaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgccacctagtacccttgtacttttggtttcacctgcatagagaaaacccacaagaatatgacagtctgatttgtcagtctcattctcaagcaacatttctctatccgttactttcatggtgaataacacaatccatcatcaatactttgtgttactcagaaactgaaagttattccgagtcttgcatatctttggacctactcgtttttctaccattattgctgattgttaagctctcgctacttgaatcggcattgttggagtgggaaggttcaaaaaattggagttatgactagttgtctctttctatgtacgatggagaaaatgaataaacaactgagaaaatggctcttgtttagttgatgatgctcttaagctttccactggttgccatatatgatttgggcatttcactttgatcttaatgggccttgtaaagcccaagactcatgattatctttagttgatgctcttaattaggtgtgggcaaataattcaaactgtatgtacccgaccaaaaccaaagcaaaaataatcgaaccaaaccgaaaatttaaaaataaccgaatgaaaactaaatcctataactgaaagaactgaaaccgaatcaaaatatttaatgtaaccaaaaatatccgaaatataattatattgtcaaaaatattaataatttctagattaaataattaaaaatacttaaaaatttatataaaatagtaaaaatactcgaaaataaccacaaatattcaaaaacaaccgaaatatcccaaaatattcaaagcaaaataaccgaatggataccaaattttaaaaccgaaaaaactggaacaaaaccaaaatcgaaccaaaatttcaaaaatcgaataaatactaaactttagaacaaaaaaaaacgataaccgaatgtatacgaaccaaagccgaattagataaccgaacgtccaggactactcttaatctttccgccacttatgatttgggctattactttgtttataatgagccttttcaagctcaagttcatgattgtccgtgagatgagaaactgacttgttggattcgaaaccctagctagtattggttaatacttaatacataaatgacctgcattgacatcatcatccaagaaaataaaaattgtatgcttgagatatttagttttcctagctaggttttctttattttagtaccgaatctttaggtgtgccacgttaatttagacccattttttcatacttaccaactgagtctagtttaatcatgactataatcgtataaaatgattcagtcgacgtcattgcgaacgtatataaaatcatccaaattgacgtcattccaaagaggtaagcatgcttatctaagagtccgagcatactaaacaagacgacattttatttgcactccaaatcaaattttgtattgcctaaagaaaaacaatcaaactcaagtttcttaaaattaatttcattcaaactaatcactttcaatatctcacatattattcatgccatttctatttgtctaaacatgatttaaaaaaaaaagtaaaatacaaagattactatgcaaaaactctataaaaaaaaattcaaatttcttatttatttgtgacatcaaattttcaaaataatttttttaattatcggttgatccggtcagtcgataaaaacataaactttcagcgaccgttaaaactttcctactaccgatttagagaaaatcttagcttgaaacgtaattgtaacctgccttcatgcaagtcgcaagatatgtcatcctaagttgtatatgttttctcaaaagatgtatttacttgagaaaatacgtttcaacgttgatggacaaccaattaagaatcaagcacctttcgtaatcaatttaggcttatcgtctaaggtatactgatttacgacagttgactagacttataaggaacaaaataatagaataatttcgtcaagaaaaattgattttggactcatactttacataatattttactcttaaatttatttaagtggctcctcgcatgatcccaaagagcaagcctagactatatggaaaagtttctaaacacttcacctaatcatagagactaagatggtaattcgtaaacgacaaagcctagtgacactgtccattgtaaaattccacatcatattagtattaaacatatacatgtagtttcctgaacacatgtagtatcaaacacacttcgtggcttcttcctcgaaacctgtccgagcttcaagtttgtacaaaaaagcaggctccggccagaatggcccggaccgggttaccgaattcgagctcggtaccctgggatccgatatcgatgggccctggccgaagcttggtcacccggtccgggcctagaaggccgatctcccgggcacccagctttcttgtacaaagtggccgttaacggatcggccagaatggcccggaccgggttaccgaattcgagctcggtaccttggtgtttgaataaatgatataaatggctcttgataatctgcattcattgagatatcaaatatttactctagagaagagtgtcatatagattgatggtccacaatcaatgaaatttttgggagacgaacatgtataaccatttgcttgaataaccttaattaaaaggtgtgattaaatgatgtttgtaacatgtagtactaaacattcataaaacacaaccaacccaagaggtattgagtattcacggctaaacaggggcataatggtaatttaaagaatgatattattttatgttaaaccctaacattggtttcggattcaacgctataaataaaaccactctcgttgctgattccatttatcgttcttattgaccctagccgctacacacttttctgcgatatctctgaggtaagcgttaacgtacccttagatcgttctttttctttttcgtctgctgatcgttgctcatattatttcgatgattgttggattcgatgctctttgttgattgatcgttctgaaaattctgatctgttgtttagattttatcgattgttaatatcaacgtttcactgcttctaaacgataatttattcatgaaactattttcccattctgatcgatcttgttttgagattttaatttgttcgattgattgttggttggtggatctatatacgagtgaacttgttgatttgcgtatttaagatgtatgtcgatttgaattgtgattgggtaattctggagtagcataacaaatccagtgttccctttttctaagggtaattctcggattgtttgctttatatctcttgaaattgccgatttgattgaatttagctcgcttagctcagatgatagagcaccacaatttttgtggtagaaatcggtttgactccgatagcggctttttactatgattgttttgtgttaaagatgattttcataatggttatatatgtctactgtttttattgattcaatatttgattgttcttttttttgcagatttgtccggtctctaaccatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaacttcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgtatgcccgacggcgaggatcttgtcgtgactcatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgcgcggaaggaggaaagtgactccttcgttgcgtagacagtatgaaaatatttttactgtgatacttacaagttgatatatggttgtgtgtaacttatttatttgagaggtattttaacacaccttagaactaaaacttaataaataaatatttctctatctttaaaggcacatattacgtggctaaggcaattacagctgatatactgtaaaactcatgtcgccactaaattcttctaacacgcgttctgtctctttccaagggactccgaatatgccactatttatctgtggcatttccaatttatattcccctattgggtatttgatgtggccgtttaaatagtcaccgattgaatcttcacttgttcgagttttgtcttttgcttctctaaaggtcttcaatttatctaaagcaagttttgtataattcaaaatactttgcttttctccatgacttgaacctccaaatgatgaggtaccctgggatccgatatcgatgggccctggccgaagcttggtcacccggtccgggcctagaaggccagcttcggccgccccgggcaacttta

SEQ ID NO: 112 - DNA, 1522 bp, Bordetella bronchiseptica
ctaccggcgcggcagcgttacccgtgtcggcggctccaacggctcgccatcgtccagaaaacacggctcatcgggcatcggcaggcgctgctgcccgcgccgttcccattcctccgtttcggtcaaggctggcaggtctggttccatgcccggaatgccgggctggctgggcggctcctcgccggggccggtcggtagttgctgctcgcccggatacagggtcgggatgcggcgcaggtcgccatgccccaacagcgattcgtcctggtcgtcgtgatcaaccaccacggcggcactgaacaccgacaggcgcaactggtcgcggggctggccccacgccacgcggtcattgaccacgtaggccgacacggtgccggggccgttgagcttcacgacggagatccagcgctcggccaccaagtccttgactgcgtattggaccgtccgcaaagaacgtccgatgagcttggaaagtgtcttctggctgaccaccacggcgttctggtggcccatctgcgccacgaggtgatgcagcagcattgccgccgtgggtttcctcgcaataagcccggcccacgcctcatgcgctttgcgttccgtttgcacccagtgaccgggcttgttcttggcttgaatgccgatttctctggactgcgtggccatgcttatctccatgcggtaggggtgccgcacggttgcggcaccatgcgcaatcagctgcaacttttcggcagcgcgacaacaattatgcgttgcgtaaaagtggcagtcaattacagattttctttaacctacgcaatgagctattgcggggggtgccgcaatgagctgttgcgtaccccccttttttaagttgttgatttttaagtctttcgcatttcgccctatatctagttctttggtgcccaaagaagggcacccctgcggggttcccccacgccttcggcgcggctccccctccggcaaaaagtggcccctccggggcttgttgatcgactgcgcggccttcggccttgcccaaggtggcgctgcccccttggaacccccgcactcgccgccgtgaggctcggggggcaggcgggcgggcttcgcccttcgactgcccccactcgcataggcttgggtcgttccaggcgcgtcaaggccaagccgctgcgcggtcgctgcgcgagccttgacccgccttccacttggtgtccaaccggcaagcgaagcgcgcaggccgcaggccggaggcttttccccagagaaaattaaaaaaattgatggggcaaggccgcaggccgcgcagttggagccggtgggtatgtggtcgaaggctgggtagccggtgggcaatccctgtggtcaagctcgtgggcaggcgcagcctgtccatcagcttgtccagcagggttgtccacgggccgagcgaagcgagccagccggtggccgctcgcggccatcgtccacatatccacgggctggcaagggagcgcagcgaccgcgcagggcgaagcccggagagcaagcccgtaggggg

SEQ ID NO: 113 - DNA, 34247 bp, Artificial Sequence
  synthetic construct
aaatatcagccgcttgtgtgttcaattcttctctgtttcacttgaaacaaattgaatagatattcccgctttcaaagccatttacaaatcctctcgtgcagcctaacgccattggcgtggaacaagcgttggcacgaggaagtaagtgcgatgaacggaaggtattcaccgacgcggcaggattttaagacaggcgcgaagccttggtctatattagcccttatcgttgccgcaatgattttcgcgttcatggcggttgcgtcctggcaggacaatgggactacccaggcaatccttagccaaatacgatcgattaacgctgacagcgcctcactgcagcgcgatgtactccgcgctcacacgggcaccgtggcgaactaccgccccattatctccaggctgggagctctgcggaagaatctggaagatttgaagcaattatttaggcaatctcatattgtaagtgagagcaatgctgctcaactgctacgccggctagaagtgtctctaaattcggctgacgcggcggtcgccgcctttggtgcgcaaaatgtccgcctgcaagattcgctggccagtttcactcgtgctttaagcaatcttccaggaaaggcctcaggcgatcagactttagaaaaaccaacagaattggctagcatgatgctccaatttcttcggcaaccaagcccggctatttcattcgagatcagccttgaactagagaggctccaaaaacaacgcggtcttgatgaagctcccgtgcgcatactttcgcgtgaaggtcccattatcttatcgcttttgccacaggtgaacgatctggtgaacatgattcagacgtctgacaccgcagaaattgcggaaatgttgcagcgtgagtgtttggaggtctatagcttgaaaaatgtggaggagcggagcgcacgtatctttcttgggtccgcttcagtgggtctttgcctgtacatcatcaccttagtctataggctacgcaaaaaaaccgattggttagcgcggcgtttagattacgaagagctaatcaaagagatcggagtatgttttgaaggtgaggcggccactacgtcgtccgcgcaagctgcacttggtattattcagcgcttctttgatgccgatacgtgcgcgttagctctagtggaccatgaccgtaggtgggctgtcgaaacattcggtgcgaagcacccaaaacccgtgtgggacgacagggtgctacgcgaaatagtctctcgtaccaaagcgaacgaacgggcgacggtattccgcatcgtatcgacgcaaaaaatcgtacatttgcctcccgaaattccaggtctttcgatactactggctcacaaatccacagataaactaattgcggtttgttcactgggttaccaaagctatcgccctcgaccttgccaaggcgaaattcagcttcttgaactcgccaccgcctgcctctgtcactatatcgatgttcggcgtaagcagaccgaatgcgacgttttggccagacgattggagcatgcgcaacgccttgaggcagttggtacacttgccggcggaatagcacatgaatttaataacattttggggtcaatcctcgggcacgcagaattggcccaaaactcggtgtctcgaacatctgtcacccgaagatacattgactatatcatttcgtcaggcgacagagccatgctcattatcgatcagatcttgacgctgagccgaaaacaagagcgcgtgatcaagccatttagtgtctcagagcttgtgaccgaaatcgctcccttgctacgtatggctcttcccccaaccatcgagcttagtttcagatttgatcaaatgcagagcgtgatcgaaggaagcccgcttgaacttcaacaggtactaattaacctctgcaagaatgcttcccaagccatgactgcaaatggtcaaatcgacatcttcgtcggccaagcttatttaccagctaagaaaattctggcgcatggtgttatgccacctggcgactatgttctactatctgtcagcgacaatggtggaggcatttcagaggctgtgctaccctacatttttgaacccttctttacgacacgtgctcgcaacggtggaacgggtctcggcctcgcttctgtgcatggtcatatcagcgcgtttgcaggttacatcgacgttagttcaactgttgggcatgggacgcgctttgacatttatctccctccgtcttctaaggagcccgtcaatcccgacagctttttcggccgcaataaggcaccgcgtggaaacggggagattgtggcacttgttgagcccgatgacctcctgcgggaggcgtatgaagacaagatcgccgctctgggatatgagccggtcggttttcgtacctttagtgaaattcgcgattggatttcaaaaggcaatgaagccgatctggtcatggtcgaccaagcgtctcttcctgaagatcaaagtcctaattccgtggatttagtgctcaagaccgcctccatcatcattggcggaaatgatctcaaaatgcccctttcaagggagaatgcgaccagggacctttatctgccgaagccgatatcgtccagaactatggcgcatgcaatcctaaccaaaatcaagacgtagagttgcgacgtatcaggactgggcaatcgcggccgccgggcttacgtgtcttttgtaacaaattgcgacgcagttgatatccacttgaaacattagtccgaaattatcgagatctccgctgataaggtatcgaaatggcgataaaattggtattgatactcgtattcacactctttcccgcggcagacgctgcatatgcgaatgaccgcgccaacggtttcatgtggtcaaacgggggcgaaactggagtgaggcttcctcttcgggtgttcaatgccaagccagccaagaacacggtggcgatcatttattccggagacgctggatggcaaaatatcgatgaggcgattggtacctatctgcagacggaagggattcctgtcattggcgtcagttcacttcggtatttctggtcggagcggtccccaagcgaaactgctaaggatcttggtcacataatcgatgtctacaccaagcatttcggtgtgcagaatgttttacttgtaggatattctttcggcgcggacgtcatgccggcaagcttcaataggcttacgcttgagcaaaaaaatcgggttaagcaaatctctctcttggcattgtcacatcaagtcgactatgtcgtctcatttaggggctggctccaactcgaaacggaaggtaagggcggcaatcctctggatgatctcagatccattgaccctgcaatcgtccaatgcatgtacgggcgcgaagaccgtaataatgcttgcccatctctccgacagaccggcgcagaggtgataggcttcagcggaggccatcactttgataatgatttcaaaaaactgtctacgcgcgtcgtctcaggcctcgtggcacgcctaagtcatcagtaatctttagttcctgcaccgcgggacccgcgaggtttctcgcttcaattgaaatcataaagaagcaattgaaaattttcgagtaaccgaccctcccgataatcttcaacataaaacaacgcacttcttccaacgggagaggcggtgttagttgcgagctaaggagataaggtatgcttaagagatcggggtcgctttctcttgccttgatggtctccttctgttcgtcgagccttgccacgccactctcatctgctgagtttgaccatgttgctcgcaagtgtgccccatcagttgcgacatctacgcttgcggcgatagctaaggtggagagtcgctttgatcctttagcgattcatgacaacacgaccggcgaaacgcttcactggcaagatcacagccaagcaacccaagtcgtcaggcaccgtctcgatgcacggcattcgctggatgttggcctcatgcaaataaactctcgaaatttttctatgctcggtctgacacctgacggtgcgctccaggcgtgcacatcattatctgccgctgcaaacatgctgaaaagtcgttatgcaggcggcgaaacgattgacgagaagcaatttgcgcttcgtcgggcgatctccgcttacaacaccggtaatttcatcggcggttttgcaaacggctacgtgcgaaaagttgaaacagctgctcaatcgctggtgcccgcgttaatcgagcctccaaaagacgatcacgaggcgctaaaatccgaagagacgtgggatgtttgggggtcatatcagcgccgctcgcaggaggatggcgctggcggtttaatcgctccgccaccgccacaccaggacaacggcaaatccgcagacgacaatcaagtcttattcgacttatactaaggaggtgcgcattgatgcgatgctttgagagataccgtttacatctaaatcgcctctcgctctcgaatgcgatgatgcgcgtgatatcgagctgcgccccaagcttgtgcggtgcaattgcatggagcatttcctcatccggacccgccgcagcgcaatctgcgggtggcggcactgaccccgccacaatggttaacaatatatgcacgtttatccttggtccgttcggccagtcactcgctgttctcggcattgtcgctatcgggatctcctggatgttcgggcgggcttcgcttgggctggttgccggcgtcgtcggcggcattgttatcatgtttggggcgagcttcctcggccaaacgctcactggcggtagttgatggctgatcgtttggaagaatcgaccctttacctcgcagccacacggcccgcattgtttcttggggtgccactgacattggcagggttattcatgatgttcgccggctttgtcatcgttatcgttcagaacccgctctacgaagtcgttctcgtgccgttatggtttgcagcccggctcatcgtggagcgagactacaatgcggcgagcgtcgtcctgctatttttgcggaccgcgggaagaagcattgatagtgcagtttgggggggcgctactgttagcccaaatccaattagggttcccccacgagggagaggaatggtgtgatgctcggcgcgagtggaacgaccgaaagatccggtgagatctatctcccttatattggccacctcagcgaccatatcgtccttcttgaagacggatcgatcatgaccattgcgagaattgatggcgttgcattcgagcttgaggaaactgaaatgcgcaatgcgcgttgtcgtgcgttcaacacgctgttgcgcaatatcgctgatgatcatgtgtcaatatatgctcacctcgtacgtcatgccgacgtgccatcatcggcgccgcgacacttccgtagtgttttcgccgctagcctgaacgaagcttttgaacagcgcgtgctctccggccaactcctccgcaatgaacacttccttacgttgattgtctacccacaggcggctttagggaaggtaaagaggaggttcaccaagctaagcggaaaaagggaaaacgatctcacgggccagatcaggaacatggaagatctttggcatgttgtcgctggctctcttaaagcgtatggcctgcatcgtcttggcatccgcgagaagcagggtgtgctcttcaccgaaattggcgaagcgctacggttgatcatgactggtcggttcacaccggttccggtcgtcagcggctcactcggcgcttcgatttataccgacagagtcatttgcggcaagcgaggactcgagatcagaacgccaaaagacagttacgttggatccatctattcgtttcgcgaataccctgcaaaaacacggccgggcatgctcaacgcgctgctatccctcgattttccacttgttctcacgcagagtttttcgttcctgactcgcccgcaagcgcacgcgaaacttagcctcaaatcgagccagatgctgagttccggcgataaagccgtgactcaaatcggcaaattatccgaggctgaggacgcacttgcgagcaacgaattcgttatgggctcacatcatttgagcctttgcgtctatgcagacgatctcaatagtcttggggacaggggcgcgcgggctcggacacgaatggcggatgcaggtgccgtggttgtccaagaaggtattggtatggaagcggcctattggtcccaattgccggggaattttaagtggcgcacacgccctggcgcaatcacttcacgcaatttcgcagggtttgtctctttcgaaaactttccagagggcgccagctcaggccactggggcaacgcgattgcccgatttcgtaccaatggcggaacgcctttcgactatatcccgcatgagcacgatgttggcatgacggcaatattcgggcctatcgggaggggtaagacgacgctcatgatgtttgttctagccatgctcgaacagagcatggtcgaccgtgcaggtacggtcgtgttctttgacaaggaccggggtggcgaattgctggttcgcgccacaggaggaacatatttggcacttcacagaggcacacccagcgggttggcgccgttgcgtggcctagaaaacacagcagcctcacacgattttctgcgcgaatggatcgtggctctcatcgagagtgatggtcggggtgggatttctccggaagagaaccgccgtctggtccgtggtatccatcgtcagctctcgtttgatccacaaatgcgttcaatcgcggggttacgtgaatttttgttgcatgggcccgccgaaggcgcaggagcgcggctccaacgctggtgccggggccatgcgcttggctgggcatttgacggcgaagttgacgaagtaaagttagatccgtcgattaccggcttcgacatgacgcatcttctcgaatacgaggaagtatgcgctcccgctgcagcatatctcctgcatcggattggagccatgatcgacggccgccgttttgtgatgagctgcgatgagtttcgcgcctatttgttaaaccctaaattttcgactgtcgtcgacaaattcctcctgaccgttcgaaaaaacaacgggatgctaatactggcaacgcagcaaccagagcatgttctggaatcgccgctaggagccagcttggttgcgcaatgtatgacgaagattttctatccatcaccaaccgcagatcgatcggcttatgtcgatggactgaaatgtaccgaaaaggaatttcaggcgatccgtgaagacatgacggtcggcagccgtaagtttcttcttaaacgagaaagtggaagcgtcatctgcgaatttgatctgcgggatatgcgtgaatatgtcgccgtgctttcggggcgtgccaacacggtgcgctttgcaactcgactacgcgaggcacaagaaggcaactcatctggctggctcagcgaattcatggcccgtcaccacgaggcagaagattgataaggtaggaaacgatgaagacgacgcaacttattgcaacagttttgacctgcagctttctatatattcagcccgcgcgggcgcagtttgttgttagcgacccggcaacggaggctgagacgctcgcgactgcgctcgcgactgcggagaatctcactcagactatagcgatggttacgatgttgacgtcggcctacggcgttactggactactgacttcgctcaaccagaaaaatcagtatccttcgacgaaggacctagacaatgaaatgttttcgccgcgaatgccaatgtcgaccacggcacgtgcgatcaccagcgatacagatcgtgcagtcgtgggtagtgatgctgaagcggacctgttgcgatcgcagatcaccggttccgcaaacagcgctggcattgcggctgacaatctggaaacgatggacaaacgcttgacggcgaatgctgatacgtctgctcagctttcccgatctcgcaatatcatgcaggcaaccgtgaccaatggtttgcttctcaagcagatccatgacgcaatgattcaaaatgtacaggcgacaagcctattaacgatgactaccgcgcaggccggccttcacgaggcggaagaggcggccgctcaacgcaaggagcatcaaaagaccgctgtcatctttggtgccctcccctaaggctgggcgatttgttcatccgcccgcatcctcgccgaatgcgagctcattttatccaacattatgcgacaaaccagtcaagttcaggtccaatcgatgaatttcacgattccggcgccgtttacggccattcatacgatcttcgatgtagccttcacgacaggcttggactcgatgcttgagactatccaggaggcggtgagtgcgccattgatcgcctgtgtcactctttggattattgttcagggtattttagtcatacgcggcgaagtcgatacccgtagcggtatcactcgggtgatcacggtcaccatcgttgttgctctaattgttgggcaggctaactaccaagactatgtggtttccatcttcgaaaagacggtcccaaactttgttcagcagtttagtgtaaccggcttgcctctgcagactgttccggcacagttggatacaatgttcgccgtgacccaggccgtttttcagaaaatcgcatccgaaatcggtccgatgaacgaccaggacatccttgctttccaaggggcacagtgggtcctttacggcacgctctggtctgccttcggagtttacgacgccgttggaattctcacgaaagtgcttctcgcgatcgggcctctgatcctcgtcggatatatttttgatcgcacgcgggacatcgcagctaagtggatcgggcaacttatcacctacggtctcttgcttctcctcttaaacctcgtggcaacgatcgtcatcctaaccgaagcgactgcgctcacccttatgcttggtgtaatcaccttcgccggtacgaccgcggccaagatcattggtctttacgaactcgatatgttttttctgacaggggatgcgctcattgtcgctttgccggcgatcgccggcaacattggaggcagttactggagcggcgcaacccaatctgccagcagcttgtaccgtcgcttcgctcaggttgagcgaggctaggtcgcgcaaaaattcgcctcaatggagaattctatgaagtattgcctgctgtgcctagttgtcgctttgagcggctgccagacaaacgacacattagcgagctgcaaaggcccgatcttcccgctgaatgtggggcgatggcagcctactccgtcagatcttcagctcggcaattcgggtggacgctatgacggggcctgaatatgccatgctagtggcgcgcgaaagccttgccgagcactataaggaagtagaagcctttcaaaccgcgcgagcgaaatcggcgcgacgtctctccaaactcattgcagctgtcgcagctatcgcgattttgggaaatgttgctcaagcgttcgctatagccacaatggtgccgttgagcaggcttgtgcccgtatatctatggatacggccggacggcaccgttgacagcgaggtgtctgtctcgcgattgcctgcaactcaagaggaggccgtcgttaacgcctcattgtgggagtacgttcgcctgcgcgagagttatgatgccgacaccgctcagtacgcctacgacctggtatcgaacttcagtgccccaacagtgcgccaggattaccagcaattcttcaactatcccaatcccagttcgcctcaagtcattcttggcaaacgcggcagggtggaggtcgagcacatcgcttcaaatgatgtaactccaagcacgcagcaaattcgctataaaaggaccctcgtcgttgacggcaaaatgcctgtggtgagtacgtggaccgcgacagttcgctacgaaaaggtgaccagcttgcccggcagattgagactaaccaacccggcaggtctggttgtcacctcctatcagacatcggaagataccgtttcaaacgtaggccacagcgaaccatgatcagaaaagcacttttcattttagcatgtttatttgccgctgcgactggtgcggaggctgaagacactccaatggcgggcaagctagatccgcgcatgcgttatttggcttacaatcccgatcaagtggtgcgcctctcgacggcggttggagctactttggtcgtaacattcgccacgaacgaaacggtgacagcggttgccgtttcaaatagcaaagatctagcagccctaccgcggggaaattatctatttttcaaggcaagccaggtcctcacgcctcagccagtaatcgtgctaaccgcaagcgactccgggatgcgccgttatgttttcagtataagttccaagactctgtcccacctcgataaagagcagcccgatctctattacagcgtccaattcgcctaccccgccgacgatgcggcggctcggcgaagggaggcacaacagaaggctgttgtggacagactacacgcggaagcacaatatcaacggaaagctgagaatttattggatcagcctgtcacagcccttggtgcggcggacagtaattggcactacgtcgcccaaggcgatcgttcgctgttgccactcgaagtcttcgacaatggatttacgacggtattccactttccgggcaatgtacgcataccctccatctacaccatcaatcctgatggcaaggaagctgttgccaactattcagttaaagggagcgatgtcgagatttcttcggtttcccgaggttggcgtctgagggatggccacacagtactatgtatctggaacaccgcttacgatcccgttggccaaaggccgcaaacgggcacggtgaggcccgatgtgaaacgcgtcctgaagggggcgaagggatgaataacgatagtcagcaagcggcacatgaggttgatgcatctggatccctggtctccgacaaacatcgccggcgtctttcggggtctcagaaattgatcgtcggaggtgtcgttctcgcgttatcattaagcctcatttggctaggtgggcgccaaaagaaggtgaatgagaacgcatcgccgtcaactttgatcgcaacaaacaccaagccatttcatccagctccgattgaggtgccgccggatcctccagcggttcaagaggctgttcagcctgctgctcctctaccgccgaggggcgaaccggagcggcatgagccacggccggaagaaacaccgatttttgcatatagcagcggcgatcaaggggtcagcaaacgcgccattcagggcgacacgggccgaagacaagaaggcaagcgtgacgacaactccttgccgaatggcgaagtgtccggcgagaacgatttgtcgatacgtatgaaacccaccgagctgcagcccagcagcgccacgctcttgccgcaccccgattttatggtaacgcaagggacaataattccgtgcatcttgcaaaccgcaatcgacacaaatttggcaggctatgtaaagtgtgtcttgcctcaggatattcgtggaacaacgaacaatatcgtgcttcttgatcgtggcaccaccgttgttggcgaaatacagcgtggcttgcaacagggagatgggcgcgtttttgtgttgtgggatcgcgccgagacacctgaccatgcgatgatctcgttaacatcgccaagcgcggacgaactcggtcgctcaggattgccgggctcggtcgacagccacttctggcagcgttttagcggagctatgctcttgagtgttgttcaaggcgccttccaggcagctagcacctacgccggcagctcgggtggcgggatgagcttcaacagctttcaaaataacggtgagcagacaactgagacagcccttaaggcaaccatcaacataccgccaaccctgaagaagaatcagggtgacaccgtttccattttcgtagcacgggacctcgatttctttggtgtttaccagctccgcctgactggcggcgccacgcgggggaggaaccgccgctcttaatgaattcaaatttccgcttagagataggatacattgtaaatggaagtggatccgcaactacgctttcttctgaagccgattttggaatggctcgatgacccgaagactgaagaaattgcgatcaatcgacctggagaggcatttgtgcgccaagccggcatttttaccaagatgcctttgcccgtctcttatgatgatcttgaagatatcgctattttagcgggcgcgctgagaaagcaggatgtcggaccacgtaaccccctctgcgccactgaacttcctggtggtgaacgactacaaatctgtctgccgccgaccgttccctcgggcaccgtcagcttgaccattcgacggccaagctcgcgtgtttctggtcttaaagaagtctcctcccgttatgatgcttcgaggtggaaccagtggcagacacgaaggaaacgccaaaatcaggatgatgaagctatccttcagcattttgacaacggggatttggaagcgtttctgcacgcatgcgtcgtcagccgactgacgatgttgctatgtggccctaccggaagcggcaagacaacaatgagcaagaccttgatcagcgccatccccccccaggaaaggctaatcaccatagaagatacgctcgaactcgtcattccacacgataatcatgttagactactctactccaagaacggtgctgggctgggtgctgtgagcgccgagcacttgctccaagcaagtctgcgtatgcggccggaccggatattgcttggcgagatgcgcgacgatgcagcatgggcttatctgagtgaagtcgtctcgggacatccgggatcgatttcaacaatacacggcgcgaatccaatccaaggattcaagaaactgttttcccttgtcaaaagtagcgcccaaggtgctagcttggaagatcgcacactgattgacatgctctctacggcgatcgatgtcatcattccattccgtgcctatgaggacgtttatgaagtaggcgagatctggctcgcggcggacgcacgacgccggggcgagaccataggcgatctccttaatcaatagtagctgtaacctcgaagcgtttcacttgtaacaacgattgagaacttttgtcataaaattgaaatacttggttcgcattttcgtcatccgcggtcagccgcaattctgacgaactgcccatttagctggagatgattgtacatccttcacgtgaaaatttctcaagcgctgtgaacaagggttcagattttagattgagaggtgagccgttgaaacacgttcttcttatcgatgacgatgtcgctatgcggcatcttattatcgaataccttacgatccacgccttcaaagtgaccgcggtagccgacagcacccagttcactagagtactctcttccgcgacggtcgatgtcgtggttgttgatctaaatttaggtcgtgaagatgggcttgagatcgttcgaaatctggcggcaaagtctgatattccaatcataattatcagtggcgaccgccttgaggagacggataaagttgttgcactcgagctaggagcaagtgattttatcgctaagccgtttagtacgagagagtttcttgcacgcattcgggttgccttgcgcgtgcgccccaacgttgtccgctccaaagaccgacggtctttttgttttactgactggacacttaatctcaggcaacgtcgcttgatgtccgaagctggcggtgaggtgaaacttacggcaggtgagttcaatcttctcctcgcgtttttagagaaaccccgcgacgttctatcgcgcgagcaacttctcattgccagtcgagtacgcgacgaggaggtttacgacaggagtatagatgttctcattttgcggctgcgccgcaaacttgaggcggatccgtcaagccctcaactgataaaaacagcaagaggtgccggttatttctttgacgcggacgtgcaggtttcgcacggggggacgatggcagcctgagccaattgcatttgattaatttaggtgactgaggacgcggccagcggcctcaaacctacactcaatatttggtgaggggttccgataggtccctcttcaccaattgctcgatggcttctctccagcaaagaatgacgcgagcgcggcggtagccagcttgtggccgaaagctcgagcggtctccaaccccaacggatcaaaatgacttcgagcgacctcgagcaacgcaaccgggaacatgcgtgaggtctgaacgagaacggatttttctgtagttgaagggatcggataacttttcggggccacgcgaaatgatccatctgccagcatgctttcgaaatcgtccaacgcgcgccttaaaatcatttgtagcgacttcgagggactgtattgccgaacgaggttgtcatatgttttcgacacttgaggcgcgggcggtcgcgctgaaagaaaaacctggagctttttcggggacggaggtggactaagggcatccacagttagcttaagttgtcgatcgggactgtaaatgtgatcggcgacgagaggctcacgttgctggtctttctcgtcggctttttcaggcaagtgctggaggtccagcttctggggaacaagtgtcgggttgggatggtggatctcgggtcgagcaccagcaagccgccgtgcttcgccgaccgacaatgcgggcttgcgaattgccatcttcaagcctccaagattttgctgatcagtttcgaaatgaccacgacttcctccatcgcaatccgaagattcctctctatgaggcgcatcgtcggatcagttcccgtgtttagtaatgtaagatgcaacatgccgcgttctttcatcgcggcaaatgcatctctttcatgcatgggagacggtacaactggaaggctctctagcgtctctgacatcctgcgttgcgatgttgtcaatcggccgaccgggacgcgttggcgcaaaacagctgtaggaattgccaaattttcactcaacagcagctcgatgacgtagcggtaggtagatagtgcctcatcgatgtcgagcggcgttagcatggtggggatcagaagcaggtttgagctagcgatgattgtgttgttgagctcgctcgagccgccacgcgtatcggccaacgcataatcaaatccttcgagctcggcattttcataggctgcttcaagaaggggcatttcgtcggcggaatagacttcacagcgaggatcccaggtactgctttgtaaggcgttttctctccatcgcgtcagaggccggttttcgtcggcatcaaagagggccactcgtttaccgtcatttgccaaagcagcgcaaaggcccatgagtgcggtggttttgccagcaccccctttgaaagaacaaaacgtcaaaagttgcatattctgatcccgcctatcctgtgaaaccggagtgcatttgtatttttgttcgtataaatgtttttgtgattatcgatgagtaaaagcgttgttacactatttttatttcacattcgttataagacaattgcaaatgtagcaagtatattcagtattgactgtaaatgtactgttgatttcatattgagcagggctagacttccatccgtctacccgggcacatttcgtgctggagtatccagaccttccgctttctttggaggaagctatgtcaaaacacaccagagccacgtcgagtgagactaccatcaaccagcatcgatccctgaaagttgaagggttcaaggtcgtgagtgcccgtctgcgatcggccgagtatgaaaccttttcctatcaagcgcgcctgctgggactttcggatagtatggcaattcgcgttgcggtgcgccgcatcgggggctttctcgaaatagatgcagacacacgagaaaagatggaagccatacttcagtccatcggaatactctcaagcaatgtatccatgcttctatctgcctacgccgaagaccctcgatcggatctggaggctgtgcgagatgaacgtattgcttttggcgaggctttcgccgccctcgatggactactgcgctccattttgtccgtatcccggcgacggatcgacggtcgctcgttactgaaaggtgccttgtagcacttgaccacgcacctgacgggagaaaattggatgcccgatcgcgctcaagtaatcattcgcattgtgccaggaggtggaaccaagacccttcagcagataatcaatcagctggagtacctgtcccgaaagggaaagctggaactgcagcgttcagcccggcatctcgatattcccgttccgccggatcaaatccgtgagcttgcccaaagctgggttacggaggccgggatttatgacgaaagtcagtcagacgatgacaggcaacaagacttaacaacacacattattgtaagcttccccgcaggtaccgaccaaaccgcagcttatgaagcaagccgggaatgggcagccgagatgtttgggtcaggatacgggggtggccgctataactatctgacagcctaccacgtcgaccgcgatcatccacatttacatgtcgtggtcaatcgtcgggaacttctggggcaggggtggctgaaaatatccaggcgccatccccagctgaattatgacggcttacggaaaaagatggcagagatttcacttcgtcacggcatagtcctggatgcgacttcgcgagcagaaaggggaatagcagagcgaccaatcacatatgctgaatatcgacgccttgagcggatgcaggctcaaaagattcaattcgaagatacagattttgatgagacctcgcctgaggaagatcgtcgggacctcagtcaatcgttcgatccatttcgatcggacgcatctgccggcgaaccggaccgtgcaacccgacatgacaaacaaccgcttgaaccgcacgcccgtttccaggagcccgccggctccagcatcaaagccgacgcacggatccgcgtaccattggagagcgagcggggtgcccaaccatccgcgtccaaaatccctgtaactgggcatttcgggattgagacttcgtatgtcgctgaagccagcgtgcccaaacaaagcggcaattccgatacttctcgcccggtgactgacgttgccatgcacacagtcgagcgccagcagcgatcaaaacgacgtcatgacgaggaggcaggtccgagcggagcaaaccgtaaaagattgaaggccgcgcaagttgattccgaggcaaatgtcggtgagcccgacggtcgcgatgacagcaacaaggcggctgatccggtgtctgcttccatccgtaccgagcaaccggaagcttctccaacgtgtccgcgtgaccgtcacgatggagaattgggagaacgcaaacgtgcaagaggtaatcgtcgcgacgatgggcgcggggggacctagactagtagacaggaaggaccgaataatggcaaatggtcagttcacgatacgctctgctcgcccggcctccgtcggactgacaggcgaacggcgtggagccgcatccgcctctagctctgcactgtccaatgttcaaagagatgttagggataggctgattccaactagctcaccaagattaccaaatgcagccatattgcgtgattcctcgggaagagcgtcgactggtctgcggtacatggcggctactcttcattggtctgcgatcgcgccattatcgctaataaacagcaacgacctggctccggccgcttatgactttgagacgcgaaataacgcaagaaatgtgactgccaaagtcggcagggcagtccctgttcccaagcaaggcgggctcggcaaaacgctcgcacccgtaccccttagtacacgtatatcaagggtcaattccgaccgaagactgcccgctgacgcagaagaccgccctgaaacgcgcgacccccagaaaggacgtggcagtcatggtgcgacgccaaccttacatgaaaagattggaaccgcgtttgctcgaagattgcgaaagcatacgtactatattgtttgcagttgctgccagacccggagcgcgttgacgatgggtgcaaagatttcggtgaagtcatgaactccagcaagacttcgccccagcgtatgaccctgagcatcgtatgttcgctggcagccggtttttgtgcggccagctgctatgtaacgttccgccggggcttcaacggcgaagcgatgatgacgttcgacgttttcgctttttggtatgagaccccgctttacttgggttatgccagcaccgtcttctggcgtggtttatctgttgtcatctttacctcgctgatcgttctttcaagtcagctcatcatatcgctgcgcaatcagaagcatcatgggacagctcgttgggcagaaattggcgaaatgcggcatgctggttatctgcagcgttacagtcgcatcaaggggccgatctttggaaagacatgtggtcccctttggttcggcagttatttgaccaatggcgaacagccacacagtcttgtcgtcgcgccaacgcgtgctggcaaaggcgtcggcatcgtcattccaacgctgttgaccttcaagggctcggtaatcgcccttgacgtcaagggagaattgtttgaactgacgtccagagcacgcaaagcgagcggcgacgcagttttcaagttctcccccctagatcctgagcggaagactcattgttacaatccggtcctggatattgccgcacttccgcccgaacgccagttcactgaaacacgccgtctagctgcgaaccttattacggctaagggaaagggagcagaaggctttattgacggcgcacgtgacctgttcgtcgcgggaatccttacctgcattgagcgtggcacaccaacgattggcgcggtatatgacctatttgcgcagcctggcgaaaagtataagctttttgcgcaactcgcggaggaaagcctaaacaaagaggctcagcgtatcttcgataatatggcgggcaacgacacgaaaattctgacatcgtacacctctgtgctgggcgacggtggactgaacctgtgggctgatccgcttatcaaagcagcgacaagccggtcagacttttccgtttacgatctccggaggaagaagacctgcatttatctttgtgtcagtcccaacgatctggaggtcttggcaccacttatgcgcctgatgtttcagcagctcgtgtcaatcttgcagagatcgctgccaggtgaagacgagtgccatgaagttttatttctcctcgacgaattcaaacacctgggcaagcttgaggccatagagaccgcgatcacaaccatcgccggttacagaggccgctttatgtttattattcaaagtctttcggccttgtcgggcacatacgatgacgcaggaaaacaaaactttctgagcaatactggcgtacaagtatttatggccacggctgatgacgaaactccaacctacatctcaaaagctatcggcgaatatacgtttaaagcgcgttcgacctcttacagtcaagccagaatgttcgaccacaacatccagatttctgatcaaggtgcagcccttttgcgccccgaacaagtgcgcctgctagacgatcagagtgaaatcgttctcatcaaagggcgacctccactcaaattacgaaaggtgcagtattattccgatcgtacgctgaaaggccttttcgaacgccagatgggctctctgcctgagcccgcacccttgatgctttccgactatagcaacgatcaagttcaataccacttggctccgatagcaaattttaatgaggatgctgcaccgcaaaacagaactgtggccgaggaccatggaagtgttaaagtcggtgctgatatccctgaacgcgtgatgggaataaatggtgacgaggaacaagccgatgcgggcgagataccgccggaatcggttgtgcctccagaattgacgctcgctctgaccgctcaacagcaattgttggaccagattattgcacttcagcaaagatcgaggtccgcaccggcatagcctgcgaaatgatcttaatggtgcaattcgtttcaggcggcatgttgcggttcaacaaagtgtacgccagatcccaattggccctttacgaggtgtcggtatgacaggaaagtcgaaagttcacataagaggttcggctgacgcgcttcctgacgttcctggcggaagtactaccgccccttttttaaccgaaccttctcgggatcaggttgatgcctcgtttgaggtccaaaccgactacagccagtctacttccgtgtcgtttacctatgatggtgttggacttggtcctgccgagcgtgcggcttacgagaactggtgcgaaccgggccggcccacttggaaagatcttataatcaaggcacgtgtcgatccgattgacgatgtgacctggctccgagatttagaagaggacaccccctcaaccttcagatacgaagggatgcctctgggcatcggggaacgacaggcctacgaaaattggcaagaggacgctcagccgacatgggaagaccttgttgtcagcgcacgcttgacggaacttggccgtccacacgggattaccggcgagtatacatccctcgcaggatcgaagaatacaagttcaatttcattgaagcgaaagcggagcaacttaattgatgatgagaattcatccggatcgttttcatatgacgggatgaagctcggggaagccgagcgttctgcatatggtgactgggccgaggcggagccacccacgtggaaagatttggtattgagggcacgcgtttcctcgatcaatgactctgcttggctttttgattcacaaacatcttcatcatcatttgaatacaacggtgttcccttgggcgagccggaacggcaggctctcagacaatggcaaggagacgctcagcctacctgggaagatctcgttgttaacgcgcgtatggcagaactttgccatgctggttggattgaaggtcaaaaaggttgctttgaagagcgcggggaggctctgcccgcgtcggaacgcggttcgcaacgccccattggtcaacggacagattcctccgattcttttgtgtatgatggcacaaggctcggagcacctgagcgaactgcttatgaacgctggagtaagagggaacgcccgacttgggaagatctcatcttagatgcacaccaggccaggactgaaagtgacgctgttacgacccaagcgattggtcagtcgtcctcaccggttttcttatatgaaggaaagtcgctcggagacagggaacgaaaggcttacgaaaaatggcggcagccagcccaaccgcgatggcaaaatcttgtagtgaacgctcgtctggcagaaatcgatccctcagcctggattgccgatgagcgcgatccgcttgatgatagcgacgcgcttggtcgcccgtcgtacacaagcttgacggatagatcagacgtccctttagacgatcaatcaatctatcgtcgttccgacctagtaagggagcaggtgccagaatcgtctcaaaggcaattcgcagcatgttcagaatctgaaacgaggcctgtgcaatggtttactgcttctgggtcagatgcaaacaatacggaaaatatcaccgccagcgatcccgtcgatcgcacgggtggagttaagcggctaggctccaaaagcgacagaaccgttacagcttctatccatgacgtgaattccagcacaaggcgactgttgcttaacgaatttggatcggaggctccgcgcccttcgccagaaaagactgttcgcttaagaagcgacaatattggcacctatgggagccggaaaaatgaacgagcgcggctcgcgaccgaaaccggtgcgtatgagtcggagcatattttcgggttcaaggctgtccacgatactgcgagagcgacgaaagagggccggcgtctcgaaaggcccatgcccgcctaccttgaggataaggggcttcatcgccaacatattggcaccgggagaggacggaccaaacttgtcgggcgcggatggccggatgacacaagctatcgctcggatcaaagggcaactctgtcggaccccgttgcgcgctcggaaggcgcgacggcctcaaatgggtatcaattgaaccaattgggttacgcgcaccaactcgctagcgatggcctgcaaagtgaatcgcccgatggtgttgccttgccaattcaagtggcaacaacgagctacaactatacagtgagccgcgatcctgtccttgttccgccggataaaaacgaagcccctcaattgctgcatcttggtccccgtggtcaaaccgaagctgttcttgcccgcgaaacagcattgactggaaaatggccgactctcgagcgtgagcagcaagtgtatcgcgagtttttggccttatatgacgtaaaaaaagatcttgaggccaaatcagtcggcgtaagacggaaaaaaaaagaagttatttctgcgttagaccgaactgcgcgcttgataagcacgtcgccttcgaaagctcgatccaaagcagagactgaaaaagccattgatgagctcgatgatcgacgagtttatgatccgcgtgatcgagctcaagacaaagcgtttaaacgctgataagtcgccaatatagtgatcatttgcagtattcgcatcgatcgctggttgatattctgccgctggtcgaccggctgctcgtcgccaaaaatgctcacagggatacgatggcctcggtcaggccgcgtgcgtcctgtctttccagttcctccctttcagctcgattgtggcatcatttattgcctgctcattgcagttgaaacgcgatatccgtttcaagacccgggtatggatggtactttggagatatgagcacttgccagacttcccggtcggagacttaaaaattccgataagaggttacggacgacggaccttataagtggatcgtctagtggtggcgccgatcaaaacagttccgcccccggctttgctcaaagtagcaaagcagctttatctcgggttgcggaggattttctagaaaaccgcaattttgcaggagagaacatatggccatcatcaagccgcatgtgaacaaaaataggacaacctcgccgatagagagaccggagtctctcatagaggaaatgagcggcagtcatccgccgagtggttttaccaacctggatctcgctatgatcgagctggaggactttgtccatcggtgcccgctcccagaagacaatcttgctggtcagaaggagtgagacgatggatccgtctagcaatgagaatgtctatgtgggtcgcggtcacaacatcgaaaatgatgatgacactgaccccaggcgttggaagaaggcgaatatcagttccaacaccatctccgatattcagatgacgaatggcgaagacgtacaatcagggagccctacccgaacggaagttgtaagcccacgtctggattatggatcggtcgactcctcctccagcctttattctggcagcgagcacggaaatcaagctgagattcaaaaagagctgtccgtcttgttctcgaacatgtctttgccaggcaacgatcggcgcccggacgaatacattctcgtgcatcaaacgggacaagatgcttttactggtattgccaaaggcaacctcgaccaaatgcccaccaaggcggaatttaacgcgtgctgccgtctctacagggacggagccggtaattactacccgccacctctcgcattcgacaagattagcgttccagagcaactggaggaaaaatgggggatgatggaggcgaaggaacgtaacaaactgcggtttcagtacaagttggacgtatggaatcatgcgcacgctgatatggggatcacgggcacagagatcttttatcaaacagataagaacataaagctcgaccggaattataaactaagacctgaagaccgatacgtacaaacagaaaaatacgggcgccgggaaattcaaaagcgatatcaacacgaactccaggctggttcgctgctgcccgatattatgatcaaaactccccaaaatgacatccacttcgtgtacaggtttgccggcgacaattacgccaacaaacagttcagcgagtttgaacacaccgtcaagcgcaggtatggcgacgagactgagatcaaattgaagtcaaagtcaggcattatgcatgactcgaaatatctggaatcctgggaacggggcagtgcggatattcgcttcgcggaattcgttggggaaaatagagctcacaatcggcagtttccaactgcgacagtaaatatgggacagcagccagacgggcagggcggtttgacccgcgaccgtcatgtgagcgttgacttcctaatgcaaagcgcacccaattcgccttgggcgcaagctttgaaaaagggagaactgtgggatcgcgttcagttgcttgctcgcgacggcaaccgctatctgtcgccgcccagattggaatattctgaccctgcacatttcaccgagttgatgaaccgggttggtttacccgcatcgatgggtcggcaaagccatgcggctagtatcaaattcgaaaagtttgacgcgcaggcagcggttattgtcttaaatggcccagagttacgtgacattcatgacttgtctcctgaaaaactgcaaaatttgtccaccaaagatgtcatcgtcgccgatcgcaatgagaatggtcagagaactggcacgtacaccagcgtcgcggaatatgagcgcttgcagttaaggctgccacccgatgcagcgggggtgcttggtgaagcaactgacaaatattcacgtgatttcgttcggccagagccggcgtcgcgtccaatcagtgacagccgcaggatatacgaaagtcgaccgcgtagccaaagcgtcaacagcttttgacgttcctgctgccgcgtcaacgaggaagctcgtttgacccgggtttgccaatgaaagggctcaatcatggtgaacactacaaagaaaagttttgcgaagtcgcttacggcagatatgcgccgttctgctcagcgcgttgtcgagcaaatgcgaaaagcattgattaccgaagaagaggcgctcaagcggcaagccagactggagagtcccgataggaagcgaaagtatgctgctgatatggcgatagtcgacaaactcgacgtagggtttcgaggcgaaataggctataaaattcttggaaataaccggcttcgagtagacaaccataaagaattaacgcgtgagcacggtagacttcgcaaaaccaaaacggttctgaagcgtaacccggtgacgcaggaagtctatttgggtttatatgaaaggaagtcctggttaagtgtcagcagccatttgtatgctgcggacggcacactccgcatgaagcacgtgaaatacaaagacggacgttttgaggaaaaatgggagcgcgacgaaaatggcgacctgatccgcacaaggtacgccaaccgtggcaggctctttcaacctgtatccgagaaaatgggcgcgccgtatcggagcggccctgacgaccggctctatcgcgatctaacccgtcgaaacggtttcagacgggagacattcgaacgggacgatcacggaaacctcgagcgtatcggcagcaaccatgtcggcttttccaagatttcagtgaaggcacccaatcgtcaaacctcccagacgaagattcaaaaacttggtggcgctttcaacaaatcttttaggtcccttctggacaaggagggcaatgaaatgggccgcgatattttgagccatcgacggctctataacaagcggtctgctgtctacgatgaagctaccggacaattgaagagtgccaagcataccttcggcaagatctacaggagcgaaaccgaatatctcagcgcgggcctcaagaaggtttcaaaaaagatactcggggtgacggtctaccggaaatttgcggcgctcagcgagcgagaatccgaggctgagagactgcgtagttttgaatccggtgcgcatcgccagatctggcaggagcgggcagcgattcccggttcgcccctcccggagactgatgacattcatttcgcacagcagtcgcacctagccaaagccaaccctgatcacgtcgaagctgacgtcacgcgtgtgacagatcaacatgttgatgttgctggacaaacatcatcgtctccccaacggaacttggaaggatggttagattctcaatcacgatacaagccagcaaacatgctgttgtcaaatccagaccttcaagcgaacggacctcgcccatacgaagggttagctcatctcaccctccggcgcgataatgaatctgacgggcacaaggagaatgatcagcggctgcgacatttctcccagccagagccgttggtgttaccgcatcccgggtcgccggaaataactaaggtgtttggctcgcggggagagccggcacacccgagtggaaatctgcacacggcggttggagaaacggcttgcgaaggaccggtgatgtcttcatcctcggacaatcatcagccagctccaggacagcaagaacttttaagtttccttcataatgcgccagccccagtttctgtggcaatacatgatgatcaagagcgacttgcgggggaggcgcccggcggctctttcagaggtagctcagggcgaacgagttcaatgtcggagagtatcttcgacgaagatgtacaagggcatttggtacgggattattcgatcaatactactaacgggtttattgacccgcaatcgttgttcggtgaaccggacttatcgagaggtccaaaatcggggccagaaattccatcggaagattaccatttgtcagcttcggaacaggaaaatttgctgaatcaattgcttagtgtgccactgccggttccttcaccgaagcccgaatgcgcgaggtctatgattttcgaaggttcacgttcaagagagcgttccacctccagagggttctaaggtggaacgcgtctaggcttgcctatcatcaccacctcatgatggtcgcggagaccttcgaagagatatccgacatcattggagaagctgggccggaaactagtgtacctcgcgaatgcatctagatccaatccaatatgcatggcatgccgaatccatgtgggagtttattcttgacacagatatttatgatataataactgagtaagcttaacataaggaggaaaaacatatgttacgcagcagcaacgatgttacgcagcagggcagtcgccctaaaacaaagttaggtggctcaagtatgggcatcattcgcacatgtaggctcggccctgaccaagtcaaatccatgcgggctgctcttgatcttttcggtcgtgagttcggagacgtagccacctactcccaacatcagccggactccgattacctcgggaacttgctccgtagtaagacattcatcgcgcttgctgccttcgaccaagaagcggttgttggcgctctcgcggcttacgttctgcccaagtttgagcagccgcgtagtgagatctatatctatgatctcgcagtctccggcgagcaccggaggcagggcattgccaccgcgctcatcaatctcctcaagcatgaggccaacgcgcttggtgcttatgtgatctacgtgcaagcagattacggtgacgatcccgcagtggctctctatacaaagttgggcatacgggaagaagtgatgcactttgatatcgacccaagtaccgccacctaataatgtctaacaattcgttcaagccgacgccgcttcgcggcgcggcttaactcaagcgttagatgcactatacgtaccaatccaaatcggatccccctgcagggctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagcagatctatcgatggtacctatctgcagacggaagggattcctgttaattaaaacagcttgcgtcatgcggtcgctgcgtatatgatgcgatgagtaaataaacaaatacgcaaggggaacgcatgaaggttatcgctgtacttaaccagaaaggcgggtcaggcaagacgaccatcgcaacccatctagcccgcgccctgcaactcgccggggccgatgttctgttagtcgattccgatccccagggcagtgcccgcgattgggcggccgtgcgggaagatcaaccgctaaccgttgtcggcatcgaccgcccgacgattgaccgcgacgtgaaggccatcggccggcgcgacttcgtagtgatcgacggagcgccccaggcggcggacttggctgtgtccgcgatcaaggcagccgacttcgtgctgattccggtgcagccaagcccttacgacatatgggccaccgccgacctggtggagctggttaagcagcgcattgaggtcacggatggaaggctacaagcggcctttgtcgtgtcgcgggcgatcaaaggcacgcgcatcggcggtgaggttgccgaggcgctggccgggtacgagctgcccattcttgagtcccgtatcacgcagcgcgtgagctacccaggcactgccgccgccggcacaaccgttcttgaatcagaacccgagggcgacgctgcccgcgaggtccaggcgctggccgctgaaattaaatcaaaactcatttgagttaatgaggtaaagagaaaatgagcaaaagcacaaacacgctaagtgccggccgtccgagcgcacgcagcagcaaggctgcaacgttggccagcctcgcagacacgccagccatgaagcgggtcaactttcagttgccggcggaggatcacaccaagctgaagatgtacgcggtacgccaaggcaagaccattaccgagctgctatctgaatacatcgcgcagctaccagagtaaatgagcaaatgaataaatgagtagatgaattttagcggctaaaggaggcggcatggaaaatcaagaacaaccaggcaccgacgccgtggaatgccccatgtgtggaggaacgggcggttggccaggcgtaagcggctgggttgcctgccggccctgcaatggcactggaacccccaagcccgaggaatcggcgtgagcggtcgcaaaccatccggcccggtacaaatcggcgcggcgctgggtgatgacctggtggagaagttgaaggcagcgcaggccgcccagcggcaacgcatcgaggcagaagcacgccccggtgaatcgtggcaagcagccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggcaggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctagctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagccgaagagctgcaaaaagcgcctacccttcggtcgctgcgctccctacgccccgccgcttcgcgtcggcctatgcatataattgtggtttcaaaatcggctccgtcgatactatgttatacgccaactctgaaaacaactttgaaaaagctgttttctggtatttaaattaaaaatgaagcgtacgttggaatcgcttctacaaaactcacagaaacaatcaaacaaacatacacagcgatttattcacacgaacccgaattacaacggtatatatcctgtcagccaacaccaaaacatcaaaaaaatcgggatcaggatcaggatctgcggccgcatcctgcaggtcgactctagaggatcctcatcgctatcaactttgtatagaaaagttgaacgagaaacgtaaaatgatataaatatcaatatattaaattagattttgcataaaaaacagactacataatactgtaaaacacaacatatccagtcactatggtcgacctgcagactggctgtgtataagggagcctgacatttatattccccagaacatcaggttaatggcgtttttgatgtcattttcgcggtggctgagatcagccacttcttccccgataacggagaccggcacactggccatatcggtggtcatcatgcgccagctttcatccccgatatgcaccaccgggtaaagttcacgggggactttatctgacagcagacgtgcactggccagggggatcaccatccgtcgcccgggcgtgtcaataatatcactctgtacatccacaaacagacgataacggctctctcttttataggtgtaaaccttaaactgcatttcaccagcccctgttctcgtcggcaaaagagccgttcatttcaataaaccgggcgacctcagccattccttcctgattttccgctttccagcgttcggcacgcagacgacgggcttcattctgcatggttgtgcttaccgaaccggagatattgacatcatatatgccttgagcaactgatagctgtcgctgtcaactgtcactgtaatacgctgcttcatagcatacctctttttgacatacttcgggtatacatatcagtatatattcttataccgcaaaaatcagcgcgcaaatacgcatactgttatctggcttttagtaagccggatcctctagattacgccccgcctgccactcatcgcagtactgttgtaattcattaagcattctgccgacatggaagccatcacaaacggcatgatgaacctgaatcgccagcggcatcagcaccttgtcgccttgcgtataatatttgcccatggtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaattccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgacggatcctaactcaaaatccacacattatacgagccggaagcataaagtgtaaagcctggggtgcctaatgcggccgccatagtgactggatatgttgtgttttacagtattatgtagtctgttttttatgcaaaatctaatttaatatattgatatttatatcattttacgtttctcgttcaactttattatacaaagttgatagattgtatgaattcatttacaattgaatatatcctgccattttacacctcgatatatcctgccacaaattccatgtacacagtacattaaaaacgtccgcaatgtgttattaagttgtctaagcgtcaatttgtttacaccacaatatatcctgccaccagccagccaacagctccccgaccggcagctcggcacaaaatcaccactcgatacaggcagcccatcagtccactagagggcccgccgagaatgaacgccaagaggaacaagcatgaaaccgcaccaggacggccaggacgaaccgtttttcattaccgaagagatcgaggcggagatgatcgcggccgggtacgtgttcgagccgcccgcgcacgtctcaaccgtgcggctgcatgaaatcctagg

SEQ ID NO: 114 - DNA, 45430 bp, Artificial Sequence
  synthetic construct
gctgttttctggtatttaaattaaaaatgaagcgtacgttggaatcgcttctacaaaactcacagaaacaatcaaacaaacatacacagcgatttattcacacgaacccgaattacaacggtatatatcctgtcagccaacaccaaaacatcaaaaaaatcgggatcaggatcaggatctgcggccgcatcctgcaggtcgactctagaggatcctcatcgctatcaactttgtatagaaaagttgggccgaattcgagctcggtacggccagaatccggtaagtgactagggtcacatcgaattcccataggattggggccagaatggccgcggccgcatcaggatattcttgtttaagatgttgaactctatggaggtttgtatgaactgatgatctaggaccggataagttcccttcttcatagcgaacttattcaaagaatgttttgtgtatcattcttgttacattgttattaatgaaaaaatattattggtcattggactgaacacgagtgttaaatatggaccaggccccaaataagatccattgatatatgaattaaataacaagaataaatcgagtcaccaaaccacttgccttttttaacgagacttgttcaccaacttgatacaaaagtcattatcctatgcaaatcaataatcatacaaaaatatccaataacactaaaaaattaaaagaaatggataatttcacaatatgttatacgataaagaagttacttttccaagaaattcactgattttataagcccacttgcattagataaatggcaaaaaaaaacaaaaaggaaaagaaataaagcacgaagaattctagaaaatacgaaatacgcttcaatgcagtgggacccacggttcaattattgccaattttcagctccaccgtatatttaaaaaataaaacgataatgctaaaaaaatataaatcgtaacgatcgttaaatctcaacggctggatcttatgacgaccgttagaaattgtggttgtcgacgagtcagtaataaacggcgtcaaagtggttgcagccggcacacacgagtcgtgtttatcaactcaaagcacaaatacttttcctcaacctaaaaataaggcaattagccaaaaacaactttgcgtgtaaacaacgctcaatacacgtgtcattttattattagctattgcttcaccgccttagctttctcgtgacctagtcgtcctcgtcttttcttcttcttcttctataaaacaatacccaaagagctcttcttcttcacaattcagatttcaatttctcaaaatcttaaaaactttctctcaattctctctaccgtgatcaaggtaaatttctgtgttccttattctctcaaaatcttcgattttgttttcgttcgatcccaatttcgtatatgttctttggtttagattctgttaatcttagatcgaagacgattttctgggtttgatcgttagatatcatcttaattctcgattagggtttcatagatatcatccgatttgttcaaataatttgagttttgtcgaataattactcttcgatttgtgatttctatctagatctggtgttagtttctagtttgtgcgatcgaatttgtcgattaatctgagtttttctgttaattaacagatggcctcctccgagaacgtcatcaccgagttcatgcgcttcaaggtgcgcatggagggcaccgtgaacggccacgagttcgagatcgagggcgagggcgagggccgcccctacgagggccacaacaccgtgaagctgaaggtgaccaagggcggccccctgcccttcgcctgggacatcctgtccccccagttccagtacggctccaaggtgtacgtgaagcaccccgccgacatccccgactacaagaagctgtccttccccgagggcttcaagtgggagcgcgtgatgaacttcgaggacggcggcgtggcgaccgtgacccaggactcctccctgcaggacggctgcttcatctacaaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcaggtgaagttcatcggcgtgaacttcccctccgacggccccgtgatgcagaagaagaccatgggctgggaggcctccaccgagcgcctgtacccccgcgacggcgtgctgaagggcgagacccacaaggccctgaagctgaaggacggcggccactacctggtggagttcaagtccatctacatggccaagaagcccgtgcagctgcccggctactactacgtggacgccaagctggacatcacctcccacaacgaggactacaccatcgtggagcagtacgagcgcaccgagggccgccaccacctgttcctgtagcggccaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccggccagaatggcctcaagtttgtacaaaaaagcaggctccggccagaatggcccggaccgggttaccgaattcgagctcggtaccctgggatccgatatcgatgggccctggccgaagcttggtcacccggtccgggcctagaaggccgatctcccgggcacccagctttcttgtacaaagtggccgttaacggatctggccgcggccgggtgattgcggttacatcatgtacggaaaaataattctaatccttgatttaaatttgaacttgactatttatttattctttatttcattttgtaaatcattttatgtatctcctggcaagcaattttatccaccttgcaccaacaccttcgggttccataatcaaaccaccttaacttcacaccatgctgtaactcacaccgcccagcatctccaatgtgaaagaagctaaaatttaataaacaatcatacgaagcagtgacaaaataccagatggtattaatgcttcgataaaattaattggaaagtataaaatggtagaaaataataaattataattaatttaagtaagataaaaaataattaaaaactaaaatgttaaaattttaaaaaaattattttaaataatatttaaaaacattaaaaatcattttaaaaaatttatttatagaacaattaaataaatatttcagctaataaaaaacaaaagcttacctagccttagaagacaacttgtccaacaattagatgatacccattgcccttacgttttctttaacatcaattattgtttttgtcaacaagctatcttttagttttattttattggtaaaaaatatgtcgccttcaagttgcatcatttaacacatctcgtcattagaaaaataaaactcttccctaaacgattagtagaaaaaatcattcgataataaataagaaagaaaaattagaaaaaaataacttcattttaaaaaaatcattaaggctatattttttaaatgactaattttatatagactgtaactaaaagtatacaatttattatgctatgtatcttaaagaattacttataaaaatctacggaagaatatcttacaaagtgaaaaacaaatgagaaagaatttagtgggatgattatgattttatttgaaaattgaaaaaataattattaaagactttagtggagtaagaaagctttcctattagtcttttcttatccataaaaaaaaaaaaaaaaatctagcgtgacagcttttccatagattttaataatgtaaaatactggtagcagccgaccgttcaggtaatggacactgtggtcctaacttgcaacgggtgcgggcccaatttaataacgccgtggtaacggataaagccaagcgtgaagcggtgaaggtacatctctgactccgtcaagattacgaaaccgtcaactacgaaggactccccgaaatatcatctgtgtcataaacaccaagtcacaccatacatgggcacgcgtcacaatatgattggagaacggttccaccgcatatgctataaaatgcccccacacccctcgaccctaatcgcacttcaattgcaatcaaattagttcattctctttgcgcagttccctacctctcctttcaaggttcgtagatttcttccgtttttttttcttcttctttattgtttgttctacatcagcatgatgttgatttgattgtgttttctatcgtttcatcgattataaattttcataatcagaagattcagcttttattaatgcaagaacgtccttaattgatgattttataaccgtaaattaggtctaattagagtttttttcataaagattttcagatccgtttacaacaagccttaattgttgattctgtagtcgtagattaaggtttttttcatgaactacttcagatccgttaaacaacagccttatttgttgatacttcagtcgtttttcaagaaattgttcagatccgttgataaaagccttattcgttgattctgtatggtatttcaagagatattgctcaggtcctttagcaactaccttatttgttgattctgtggccatagattaggattttttttcacgaaattgcttcttgaaattacgtgatggattttgattctgatttatcttgtgattgttgactctacagaatatgagccccgagagaaggccagctgacattcgccgtgcaactgaggctgatatgcctgctgtgtgtacaattgtcaaccactatatcgaaacttcaacagttaactttaggactgaaccacaagagccccaagagtggaccgacgatcttgtgagattgcgcgaaaggtacccttggcttgttgcagaagtggacggagaagtggcaggcatcgcctatgctggtccctggaaggccaggaatgcctacgattggactgcagagtctacagtttacgtgtccccacgtcatcagagaaccgggttaggctcaacattgtatacccacctcttgaaaagtctcgaagctcaaggtttcaaatccgtagttgctgtcattgggctccctaatgatccttctgttcgcatgcatgaggctcttggttacgccccaaggggaatgcttagagcagcaggctttaagcatggaaactggcatgatgttggattctggcagttggatttcagtttacctgttccaccaagaccagtactgcctgtgaccgaaatagtttaaaccgcgcctaggaaacttatctctgttatgaatcagaagaagttcatgtctcgtttcatttaaaactttggtggtttgtgttttggggccttgtaaagcccctgatgaataattgttcaactatgtttccgttcctgtgttatacctttctttctaatgagtaatgacatcaaacttcttctgtattgaaattatgtccttgtgagtctctttatcatcgtttcgtctttacattatatgtgctacttttgtctaatgagcctgaaaagtggctccaatggtacgcactggaagatttgttggcttctggtagatatagcgacagtgttgagcttgtaatatcatgtctcttattgctaaattagttcctttcttaacagaaaccttcaaagtttttgtttttgttttcatttacctaatgtacacatacgctggccatgactaacaacatgtccaggcttagagcatatttttttctagcttaaattgttaacttgtcattcagtaaaatccgagaattgtgaagctctaattgaagctaattcgttttataaagtcagttaaaaagtatactaaattatccaacttttcttcaaaatctcaaaattctatgacaaaacgatagtctttgtttatgtcagtaccacaaagaggtggaaaaaaacaccaaaaaaacaataagcaaactatacactgagaagaaaaataaaagagagctcaatagatgttttatactaacggtagattagatcaaagatccaagctttactctacatagagcagaacccagaatcccttcatatctcttttattctagcaccgataatctactgaaaagaagacacttagagctctgtctctttgtcaaagaagtcccagccgtcatccagaagctccttacgttcattaacagagggcaactttattatacaaagttgatagattgtatgaattcatttacaattgaatatatcctgccattttacacctcgatatatcctgccacaaattccatgtacacagtacattaaaaacgtccgcaatgtgttattaagttgtctaagcgtcaatttgtttacaccacaatatatcctgccaccagccagccaacagctccccgaccggcagctcggcacaaaatcaccactcgatacaggcagcccatcagtccactagagggcccgccgagaatgaacgccaagaggaacaagcatgaaaccgcaccaggacggccaggacgaaccgtttttcattaccgaagagatcgaggcgcgccagcgagttgctttctctcgttggctgatgggaagaaagcgcataggagtcgccgccaaattcttgtcggaccagcttggtttgttcggtcggtgtttttcaccgtggatgcggagtaatgagaaactgggtcagaccactgggctccgttgattccgcgaaatctgcttagttggattggctgtcagaaggagaggtgaccgcatgatttgggatcatttatcaccttcccgaagggttctgcttgatatcaaatcgtggtctgtattggtactggtaattgcctcgatatcttttgcggttctggccataggatcttggcaagacaacgaaagcaacgaagcgatcctgacagagctgcaatcgatcgacgtggattgcgcgatgctgcagcggaatgtgttgcgtgctcacgccggccttcttcggaattaccatcctcttatcgtccctctggggcgactgcgcacgagcgtcgcagatttacagcagctttttaggcgggcgggcctcgacggggccggtgaattttctgaattgctggcgcgggtgaagagctcagtagatgcgaccgacgcagccgttgcagcgttcggtacgcaaaatgtaatgttccaggattcgttggcgacctttaaccagtcgatagcttcgcttccgaggtctttggatacgagggatttgaactcgctagaagtcgctgagttgggctatctgatgctccagttttcgtctcagccaaatttcgagtttgcacgggaaatcaaccaacgtctcgaccggcttcaggtttcggcgaacggggataaggcaggcgtcaaggagatcgttcgcagtgggaggattatcctgactctactgccgcgattgaaagacaccgttggagtgatccaaacttctgaaaccatcgacaacacgaagaagttgcagcgagcataccttgaagcttatagcttggccagcgcgggtgaacagcgggtacgggtcttcctcggcgcagtttcggttttcttttgcttttgcataatttccctagtccataggttacatctgcgaaccaaggtgttgacgagacgactggacttcgaagaagtgatcaaaaagattgggctttgcttcgaagatgcttcagaagcaaaaccgtcgttggaatcctcaacgaatgccgcgttgggaattatccaattattctttgaagctcatcaatgcgcgctgggactggtcaacatcaatgagaatgacgttggcgtcaccttttttggaagcactcctgcgccagagtggaacgaacaacgggtgcgcgaaattgtttccacggtaggggccgaggacggcgggcggattttccgagcctatcctcaacgaaaagcgagctgcttcggtgaggactctccatttctgtgggtgctgcttgcgttcaaggtatccgatcgaatagtcgctgtctttggcctgggatttgatcgagagcatctacagacgccgaccgcacgtgaaatgcagctgatggaactagcggctgcatgtgttagccactatgcggtcattcggcgcaagcagtcccagcgagatattctggaacgtcgtttgaaacatgcggaacggcttgaagcagttggtacgcttgccggcggcattgcgcatgaatttaacaacattttgggtgcagttctgggttacgcggaaatggcacacaacgttctgcgccgtcgtactcatgctcgagactacatcgatcacatcatttctgaaggcaatcgagcgcggttgattgtcaaccagatccttgcccttagtcgaaagcgggatcgaacaacaaaaccattcgatctttcggagttagtgaccgtgatcgcgccgtcgttacgtgttgcgttgcctccgggcgtcgagctcgatttcaaatatcagagcgctccaatggttatcgaaggaaactcacttgaggtcgagcaaatactgatgaatttgtgcaaaaactctgctgaagcatgccgagagttagggcgtgtggaggtcagcgttaggaggtctgtcgtacggaaacacaaggttcttacaaacggtactattcccaccggcgagtatatccttctttcagttgaggataacggcgcaggcataacagaggcggtattatcgcacattttcgagcctttttttactacccgcgcccgcagcggtggcacgggcctgggattatccacggttcacggtcacgttagcgcgatggctggttacatcgacgtggtatcaactgtcggcagaggtacgcgcttcgacgtctacttgccaccttcgtcgaagcagccggtaaattcagagagtttttttgaccctggaagaatcccgcttgggaacggcgagattgtcgcggtggtcgaacccgacttagccacgctggaaatgtacgaggaaaagatcgcggcgctgggctatgagccagtcggctttaacacgttggatggtttaatcgactgggtgttggaaggaaaagaacctgatcttgttctaattgatcaaccgtctttgctggatggagacggtgcagggtccttaatctcaaagctggcaaaagcgcccatcatcattattggcgaaaaccagaaaaatgttcccctttctgcggatcgcgagggatctgcccgttttttggaaaagccgatttcagcaaagactctcgcctatgtcgttcgtgcgaatatcagaactgaacgaatggtcggctcgaatagcagcggaatcgtgattgcgtcataaaccgatacgccctctgaacagaagccggccgcacaacgcgattgcttattaatttaatccccagtcgcggaatcagccggtcagtcccgacatccgcaacaacgcaactccggttgcggctgcaatcaccgccagtgatatacaggcaaaaaaccggtaaacctgctcttttgatgttaagaggagatggatcgaagcgatcatcagaaggaaaatcgtcgcaagtgcgccatacgcccaatactcgttcgaataaagccatgttcccaaagccaacagaccgcaaacaaaaaaaacgagttcgagcttttgcaagacaacacctcaaaaagatctcgttgtgatcctaggacatcggtctcgcaggtcaatactgcgatcgcgtttcatgcaacggacttgatgtatctgccgcgcggcactaggagacgtgaggaacggccccctgtctagggtgcagtcggtgccgatctccgcttcgggggcgctttgcgaaatctcctgcggctgcaccatcctccgcgccagcctgcgaaaattttcgaaaaccgccgctatggtgaattcgctctcatggcctagggatcaccgcttgggccgccgattccctcgattcaagaaatcaaacggcttcgcttcgatgcttcaaatgaaaccgagaggtaagataataaaatcagaaagtaacagacacctcccatagtcgcgactgttagcgatcgagtcatttcatgctgaccaagatcattgcgatacagtggggaataaacaatgcggaagacggcaggatctttcgggatcatttttctgatggtccagccaagcaaagctgcgccgctctcgttcgctgaatttaaccaactcgctcgcgaatgcgcaccttcagtcgctccatcgacgcttggagcgattgcgaaggttgaaagtcagtttgatccgctcgtgctgcatgacaataccaccggcgaaactttacatggcaagaatccggcggatgctacgcaaagcgtaaacaatcgcgtcgcagcagggcattcagtcgatgtaggcctaatgcaagtgaactcgaaaaatttcgcgaacttgggcttgactgccggcaatgcaatcaacccttgcgtgtccctgtcggcggcggcggacctgctcgtacggcattatagtggcggcgacacggtagagtcagaacaacttgccatccggcgagcaatttcggcttacaataccggcaacccgacacgcggcttcgcgaacggctatgtgcggagggtcgaagtggcggctcagctactcgtccccccgctggctcagtcggggaaaaaaggcgaccgtgatgagcggagtccagaagaaccctggaacgtctggggttcatacgaccgctcccactcagcagtcggttcgtccgcgccgccagaggcgcagcagccgaatgagcgcaaatcccccgaacaagatcaagttttcgaaccgaatgatggagatgcaccataatggcatggcttgaaggataccgcgcaccgtcgaaattccgtggcctctggcacagagctgtgcgcctgctggctccgcacgtgccgagcgtcaccggcgcgatcggctggagcttgtttttctgcgagccagctgccgcgcaggccgctgggggcactgaccccgccaccatggtcaacaatatctgcacgtttattctcggtccgtttggtcaatcgctcgccgttcttggtatcgtagccatcggggtatcgtggatgttcggccgagcttcccttggtctggtagcaggtgttgttggcgggatcgttatcatgtttggagccagctttctcggccaaacactgacagggggcgggggatgaatgccgatcttgaagaagccacactctacttggcggcaacgagacctgcattgttctttggggtaccgctgacgcttgctggagttttcatgatgttggcggggtttctcatcgttgttgtgcagaaccccctctatgaaattgttctcttgccgctgtggcttggagcgcggctcatcgtagagcgggactataacgcggcaagcgtggtcttgctgtttctccagacggcagggagaagcgttgacggccatgcgtggggcggcgcgagcgtcagtcccaaccccatcagagtggcgtcgcgaggaagaggaatgacgtaatgttcggagcaagcggacggaccgagagatctggggaaatctacctgccttacgtagggcacctcagcgaccatgtcgttcttctagaggacggttccatcttgaccatggcgcatatcagtggccttcccttcgaactggaggaagtagaggtccgaaatgcgcgctgccgtgcctttaacacgctctttcgcaatattgccgatgataacgtctcagtatatgcccatctcgtccgtcacaacgatgtgccagtaccgccggtacgccattttcgcagcaccttcgcgtcaagcctaagcgaaacgttcgagcggcgtgttctgtctggtaaactgtttcgaaacgaccacttcctcacgctcattgtctctcctcgcaccgctctcggtaaagtgggaagcagattcaccaggcgctatgggaagaacccaggcgatcttgcgcatcagatccgacatctggaggatctttggaacgttgtcgctggcgcgcttgatgggtatggacttcgtcgacttggcatccgagaaaaaaatcaggtgcttttcacggaaattggtgaagcccttcgcctgataatgacttgtcgttttttaccggtgccggtcgttagcggatccctcggcgcctcagtttataccgaccgggtcatctgcggcaagcgtgccctcgagattagagcgccgaaagatcgttacgttggatctatcttttcattccgcgagtacccggcaaagacgcggcccggaatgcttaacacactcctgtcatcaagttttccgctcgttttgagccagagtttctctttcctcacacgtgcacaggctcacgccaagctcagcctcaaatcgaaccagatgactagctccggtgacaaggcggtcacccagatcggtgaactcgcccaagcagaagattcattggccagtagcgaattcgtcatgggttcgcatcatctcagcctttgtgtctatggcgatgatctcgatacccttgccgactatggtgcgcgagcccgcacgagcttgtcggacgcgggcgcggttatcgtgcaggaaagcattggaatggaggctgcatactggtctcagcttccaggaaaccacagatggcgtacccgtcccggagcgatcacttcacgcaactttgccggcttggtttcattcgagaacttccctatcggaaggaagtcgggccattggggaggtgcggttgctcgtttccgtacaaacggcgggacgcccttcgattatattccgcacgaaaacgacgtgggcatgaccgcgatcttcgggccgattggcaggggaaaaacgacacttatgaccttcatcctggcgatgcttgagcagagcgtggttgaccgcagcgggacgatcgtttttttcgataaggatcgtggcggtgaactgcttgtgcgcgccaccgggggcacgtacctcacgttacgacgaggtgtcccaagcggccttgcacctttgcgcggcctagaggatacggcagcggcgcgggactttctccgcgagtggatcgtggcgctgattgaaagcgacggcagggggggaatttcgccggaggaaaatcgccgcttagagcgcggtatccaacggcaactttcgtttgagcctaacatgagatcccttgcgggcttaagggagttcttattgcacgggccctccgaaggtgcgggagctagattgcagcggtggtgccgaggcaacgctcttggctgggcgtttgacggcgaatcggacgaagtgaagttagatccttcgattacgggcttcgatatgacccatctcctcgaatatgaggaggtatgcgcgccggccgcagcataccttttgcatcgaataggagcgatggtagatggccgacgcttcgtcatgagctgcgatgagtttcgttcctacctgcttaatcagaaattcgcagcagtcgtcgacaagttcctgctgaccgtccggaagaacaacggaatgttagttcttgcgacgcagcaacccgagcacgtacttgattcaccattgggcgcaagcctcgtagcacaatgtatgaccaaaatcttctacccatcacccactgcagaccgctctgcttacatagacgggttgaagtgcaccgagcgagaatttcaggctattcgcgaggagatggcgattggcagccgcaaatttctgctgaagcgcgagagcggaagtgttgtgtgcgaattcgatctgcgcgacatgccggaatacgtcgccgtactatccgggcgtgccaatacggtgcgttttgcccagcagttgcgcgagacgcatggagaggaaccctctgcctggctggaaaaattcatgacgcgctaccatgaggcacaggattgatctggagttcgaagtcatgaatattacgaagctcgtaataaacgcacttttcatatgccttgttctgtcggggactgccaaggcgcagtttgttgtcagcgaccctgcaacggaggccgaaacgctgacgacagcgatcaatactgcggcgaacctcgagcaattgatcacgatggtgacaatgttgacctcgccctttggcgtcaccggcatgttatcagcgatcgaccagaaaaaccaatatccctctgccggccaactcgacaaggaaatgttttcgccgcagatgcctgcttcgacaactgcgcgtgcaattaccttagatgccgatcgcgcagtcgtgggcgacgacgctgaaggaaatcttttgcgacagcagattgcaggcgccgcaaatgctgccggtgtcgcggctgacaatctggatgcaatggacaagcgccttgcggcaaattctgagacatcgggccagctctcccgctcacgcaatatcatgcaggccaccgtcaccaacggtttgcttctcaaacagatccatgacgcaattattcaaaacattcaggcgaccagcctgttgacgatgaccaccgcacaggcggggctgcacgaggcggaggaggcggcgacccaacgaaaggaacatcaggcaactgcgcttatatttggcgccgctcaactacactgatccgctactgttcattcagggccctctttctccgtagaaaatcgaagctaaatccaggtaagggcaatgaattttagcattcctgcgccttttacggcgatacatacgatattcgacctcgccttcaccgtcgggctggacacgttgcttggggacattcaacgggcagtcagcgctcctctcgtggcctgcgtgacgctatggatcattgtccagggcatcctcgtaatgcgtggggaaatggacgcacggggcggaatcacccgggtaatcatggtatcggtagttgttgctcttatcgttgagcaggcggaatatcatgattacgttgtctcggttttcgaggatacgattccgaatttcattcaacagttcggtatcagtgggcttcctttgcagacgattcctgctcagctcgacacgatgttttcactcacgcaagtagcctttcagaagattgcttctgaaattgggccgatgaacgatcaagacatcctcgcctttcaaggcgcacaatggattttctatggaacgctttggactgcgtttggaatctacgatgccgtcggaatcctcaccaaggtgctattggcgatcggtccattgatgctcgttggctatctcttcgatcgcactagagacatggccgcgaaatggatcggccagctcgtcacttatggcatacttctgcttcttctaaacatagtggcaactatcgtggttctgacggaagcgacggcactcgtgctaatgctcggggttatcacttctgctggcacaacggcggccaagataataggcctctatgaactcgacatgttctttctgaccggcgacgccttgatcgtcgctcttccggcaatcgccgggaatattggagggagctattggagcggtgcgacgcaaacggccggtagcttaaatcgccatttcgcccggacaatccgccgttagtcccagcttcacaaatggaggatttccttgaagtactttctattgtttttgatcatcggcttggcgtcttgtcagacaagcgatcagttggcgacttgtaaggggcctatttttccgctgaacgtcgggcgatggcagcctgctcagtcggaccttcagcctaccaacgcaggagaggctaatgaacggctctgaatacgcgctgttagtagagcgggaagcattggcggaccactataaggaagtagaagcatttcagtctgcacgtgctagatcagctcggcgaatctctagagccttggctgctttggctgtcattgcagtcgcaggaaacgtggcgcaggccttcgctatcgccgtcatgcttccgctgaacaaacttgttccagtatatctgtgggtgcgcccagacggtacagttgacagtgaggtatctatttcgcggttgccggcgacgcaggagcaagcggtcgtgaatgcgtctctatgggagtatgttcgtctgcgggagagctactcggcggatacagcccaatacgcctatgatctggtctcgagcttcagtgccccaacggtgcgtcaagattatcagcagttcttcaattaccccagtcctagctccccccaaaccatcattggtaagcgcggaaagctggaagccgagcacatcggctcaaacgaacttatgactggcgtccagcagatccgctacaaacgcactctcatcatggaagggcaagctccaatagtaaccacctggaccgcaacggtacattatgaaacggtaactaacttgcccggccgattgaggctgacaaatccaggcggcttaatcgttacctcctatcaaacttcggaagataccgtttcgaacacgacgcggagccagcaatgatcaagaatttgtttctgggcctggtttgtatcctctttgtaaccagcggcgcgaacgcggaagacacgccagcggcaggcaaactggatccacgtatgcgctatctcgcctacaatcccgatgaggttgtgcacctttcaaccgctgttggagccacattggtcgtaacatttgggtccaatgaagcggtgacagccgtcgccgtttccaacagcaaagatctcgctgcgctcccacgcggcaattatctgtttttcaaggccagcaaagtgctgcagccgcagcctgtgatcgtccttaccgcaagcgacgcaggaatgcggcgctatgttttcagcctcgcgaccagaacgatgtctcggctcgataaagagcagcctgacctctactacagcgtacagttcacttatcctgccgacgttgccgctgctcgccgaaaagaagcggagcagagagatcttgcggatcggatgcgggcgcaagcacaatatcagcgtcgagccgaggacttgctcgagcgtccgccagcaggtggcagcacagatgcgaaaaattggagctatgtcgcgcaaggagaccgctcgctattaccgctcgaggttttcgacaacgggtattccacgacatttcgctttcccggaaacgtgcgtgtaccttcaatctacgtgattaacccagatggcaaggaagccacggccaactattcagttaagggagattacgttgaagtagcatcagtttccagggaatggcgtctgcgggacggccatacagtactttgcatctggaataaggcatatgacgccgtcggacggaagccgggcactggcacagtcagacccgatgtagtgcgcgtgctgaaggagacgaggtgatggaggacgtgaatgcccaatccagagaaggtatcgacgcgcccggatccctcgtcaccgatcctcatggccggcgcctctcggggtcgcaaaagctccttgttgcgggtttagtcctggtactgtcgttgagcctcatttggctcggggcgcgttcaaagaaaaggaccgagccgtctccaccaaacacaatgatcgatgccaacacgaagccctttcggccggccccgattgatattcccgccaaaccggcaatgacaccgccagctgcggaagcaacggttttgccgtcggatcaacatcagcgagaacacaacgaactgaggcccgaagaaacaccgatctttgcctacagcggaggtgatcagaatggtgtcaaatccgccccacacgctgatattcagaacggtggccaagacaatagaaacgccaactccctagccgcgtcggaggattctgctgagaacgatctctctgtgcgcttgaaaccgacagtgttgcagcctagcctcgctatacttttgccgcacccagatttcactgttacgcaaggaacgatcattccctgcatactgcaaaccgccattgatacaaatctggcagggtatgtgaaatgtgtacttcctcaagacatacgcggagcaaccggaaatgttgtgcttctggatcgcggaacgacagttgtcggcgaaatccagcgtggactgcagcagggagacgcccgcgttttcgttctctggaatcgcgcggagacgccctcacacgccgtcgtctctctttcctccccgggggccgacgaactcggccgttccggactgccgggtacggtcgacaatcatttctggaaacgctttagcggggccatgctcctgagtgtcgtccagggcgcagtccaggcggcaagtagctacgcagggaattcgaccggcgggaccagcttcaatagtttccaaaacaatggcgaacaagcggccgatacggccctaagggcggccataaacattcccccaaccttgaaaaaaaatcagggtgacacggtctcgatcttcgtcgcgcgggatttggatttctcaggaatctaccagcttcatatgactggtggatcggtgaaacgtcggcatctgcgctaatgcacagatagccaaagctgcgagatgcatccaatggaagtaaatccgcaattgcgcgcccttcttaacccagtcttgcaatggctcgatgacccgaggactgaagaagttgccataaacggaccgggagaagcctttgtacgccaaagtggcgtcttcacgaggttcgccgcaccgttctcttatgatgatctcgaagacatcgccattctagcaggggcattgcgaaaacaagatgtcggcccccgcaaccctctttgcgctaccgagctcccaggtggcgagcggatgcaaatctgcttgccgccaacggtaccctctggcaccgtgagcttgacaattcgacgaccgagcaatcgtgtctctgaattgggggaagtctcggctcgctacgatgttcgtcgatggaatcagtggcaaatccggacgcagcgacgagatcaactagacgaagcgattctgcgcgactacgacaatggcgatctggaatcatttttacgtgcatgtgttatcggtaagcggacgatgttgctttgtgggccgaccggaagcggcaagaccacgatgagcaagaccttgatcagtgctattccgcgggaagaaaggctgataaccattgaagatacgctcgaactcgtcattccacatgagaaccacgtcagactgctctactccaagagtggggcagggctaggtgcagtgactgcggaacagctgctccaggcaagccttcggatgcggcctgaccgaatattgctcggtgagatgcgcgacgacgcggcgtgggcgtacctgagtgaggtggtctcaggccaccccggatcgatttcaaccatacatggggcgaatcccgtccaaggcttcaaaaagctgttctcacttgtgaagagcagtgtgcagggggcatgcttggaagatcgcacactgattgacatgttggcaacggcaatcgatgtcattgttcccttccgtgcttacggcgatgtttacgaagtgggcgaagtatggctcgccgccgatgcccgccgacgcggtgagacgataggggatcttctaaaccagcaatagagccgcacggaggtctgctcgcgcagattttaaagcgttacaagtgtagcgcgctgcagcaactcctgtcatcaatctgaaaccttccgttagcatttttgtcatgcacggcttggccgaaattttgccgaactaccctcatagtgagagaaaatgatcaggttgaggctgagacgtacatcctctgcttgcacgaatctatcgattctgcagaatcccatacggaggcgaactggtgaaacatgttcttgtcatcgatgacgatgccgcgatgcgccatcttattaccgagtatttaacgattcatgccttaagggtcaccgcggtatcagatagccagcaattcaaccgggtacttgcatcagagacggtcgatgtcgtcgtcgtggatctcaatttagggcgtgaagacggacttgagatcgttcgcagtctcgccacaaaatccgatgttccaattataatcatcagcggtgatcgccttgaggaggcggataaagtggtggcgctcgagctgggagcaacggattttatcgcgaaacctttcggaacgcgcgagttcctagcacgcatccgtgtcgcattacgcgtgcgaccgaatgtcatgcgaaccaaagaccggcgttcattttgtttcgccggctggacacttagtctcagacagcggcgattggtatccgcacaaaatggcgaggtgaagcttacggcaggggaattcaatctgctcgtcgctttcctggaaaagccacgcgacgtgctttcccgagaacagctcctcatcgcgagccgagtgcgtgaggaggaagtatatgacagaagcattgatgttctcattttgaggctccgccgaaagcttgagcaggatgcagcgagcccaaacttgatcaaaactgccaggggtgccggctatttcttcgacgctgatgtggatgtttcctatggaggtctgatggcggcctgaagcagcgacgcatatgcctttttcgatctgatcctaggacgcggactcgttaattgaagcgatccagattctcgtcgcggcaagtttgagcccggcaaggtagttgaacaatctcctttccaggaaattgaatcacacaacgtcatcaacatgaaccccgttatggggacacagcctagagtgagctggctgtgttgtagctgggtaggggctgcctcattgcctgctgtcgaatacaataccgccgtcaagtgaccggcctcatcatattagcgttcttttcttatcttctcttcggcaaagaaagatgcaagtgcggccgtagccagtttgtggccaaaagccctggcggtctccaatctcaatggatcaaagtgattgcgtgcgacttctaacagcgataccgggaacatgcgagaagtcaggacaacgataggtttttcgactacttttgagatcgggtagctttgaggccccgtgctaaatgatccgtccgccaacatgttctcaaaatcggcgagcgcacggcgcaagatcatctgcagcgccttggtagcgctgtactgcagaatcaagttgtcatatatcttcgatacctcaggagcgggggggcgtgccgaaagaaagacctggactttttccggcggcgcagtcgaactcaaggcgtccgccgttagcattgattgccgatcgaagttgtcacgacgtttggcggcgataggaggcgctggtcgtttttcctttccggctctttcaggtaattgcgaaggcgccaagttttgcgaggaaagagctgggattgggtgaacgatcggtcgcgcggcagcaagccgtcttgcttcaccgacagacaaagcaggtttgcggatccccatcttcaattccccaaggtatcgccaatcaattctgaaattgttacgagttcctccatcgcaattctgaggttccgctcaaggaggcgcatcgtcggatcatttgtcgtgttcagcaatgtgagatgcaacatgccacgctctttcattgcagcgaacgcgtctcgttcatgcattggagattgtacgacaggcagattcaccagcatgtctgacatcgcgcgttgtgacgtggttaatcggccaaccgggactcgctggcgtaacacggcggtcggaatcactaagttctcgctcagcagcagctcgacaacataacgatatgtcgaaagtgcctcatcgatatccagcggcgttaacattgtcgggatcagaagcaggtttgagctagcgatgattgtgttattgagctcgctcgaaccaccatgcgtatcggccagcgcataatcaaattcctgaagctcggcgtcctcataagccgcttcaagaagcgacatttcttctgcagcgtacacctcgcaggatgtatcccaggtgttgctacgcatcgcgttttctttccatcgcgttaacggccggttctcgtccgcatcgaagagagccactcttttgccgtctcttgcaaacgcagcgcaaaggcccatgagcgccgtggttttgccggcgcctcctttaaatgagcaaaatgtcagaagtttcataagtttatcctggcgacgttgtgaacgaaagtgcgtctgtatcattgtttgtatgtgtgactgtctgtatagcgaaattatcaggagtatatttcaattgcattgaaggatagttgcaaatgtaactatatagatccgaatatgaacagtatattcttgaatttattctgttggcggctaggctccctcagtctcaactggagaatttcactccggaacaaatccagatcattccgttttctatggagcaagccatgtcgcaaagcgaaaaatccacttcaagtgacattgtcgaccggcgtgaaggcccgaagattgaaggtttcaaggtcgttagcactcgtttgcgatcgtcggaatatgagagcttctctcgccaagcccgtctgctggggctctccgacagcatggccataagagttgcggttcgccgcattgccggctttctcgaaatcgatgcagagactcgtcagatgatggaagccattcttcattcaataggagcactctcaaacaacattgccgcgctgctgtgtgcctatgctgaaaatccgacaacggatttgggcgctctgcaagctgaacgaaacgctttcggtaaatcgttcgctgatctcgacggtttgctccgttccattttgtccgtatcacggcgacggatcgacggttgctccatgctggcggacgccttgcagcattaacgtagcacttgggggaatctgttggatgcccgatcggtctcaagtcatcatccgcattgtgccgggaggtgggacgaagaccctccaacagattatcaaccagttggagtatctatctcggaagggcaagttggagctgcagcgttcggcccgacatctcgatactttcgtaccaccggatgaaatccgcgaactcgccctaagctgggttcaagaaaccgggacttatcacgaaagtcggccagacgaggaaaggcaacaggagttgacgacccacattattgtaagcttccctgccggtacaagtcaggtagcagcttatgcagcgagccgggagtgggcagccgagatgtttgggtcaggcgcagggggaggccgatacaactatcttacagcctttcacatcgatcgcgatcacccacatctgcatgtggtcgttaatcgtcgcgaacttttggggcacggctggctgaaaatatcccggcgccacccccaactgaattatgacgccttgcgcattacaatggccgagatttcacttcgtcatggcgtcgtcctcgaggcgacgagccgagctgagcgcggcatctcggagcggccgatgacttttgcccagtatcgacgcctggagcggcagcaggccaatcaaattcgtttcgaggatattgatttcgaagaattctcgcctgggggaaacgacggagaaccggatcaatcttttaattcttcgtacggttcgctgcctcaaaacgtgtcagaaaacttgcgacgaaacggcggtctgcaatcggtgtctgaagtacgttcccgggcactgatcggatcgaacggcaacggtgtcacgcccgatcgtgtatcatctggaaacgattcccgttctcaatccggcagcgataaagcctttgtggacgatggcaacttgaggaacggccctctcaccatcgccggagacggccaggatcttgaaggccgttctggcatgcatcgtttggcaaccgaacccgtcacgcacacaacaagcgaagatgatgttcggcaacggcctcatcgaaaacggcctcgcggtgatgaggaagagcagagcggcgcaaaactgaccagggtagacggaattcggacgggagtgacaatcagcgccgtaccggttgcccaggacgatccgattacatcgccgatccagccccctggatcaaatccgttggatgacccggggcagaccaacatcgctacggacgcattgcctccgacagccgatcgccggcagcagggagagccaaattctaagcgtcctcgtgatgatgacgccgagccgagcattcgtaagcggtcaagggacgggcgcagccaaggggatgagggaaacagaaggtagaaaaggatcgatcatggcagatgaagaatttcgtcgagacttcagccgctccgctacgttgaactcgaataacgaaggcgctacaggcgcaccaatcccggatacatcggtgtcgactgccttccgacaaaaccgcagagaacacttaacgaccagttccttacggccattaattactggtggggccggcgaccttccaggcacttcccccgaaaatcaacggccgacaacccatgccccgaatacagcagaaatactcccggtgagatcagccgaagctccggctggccaatcagcggtctttccgaggagcaaggggtattttcgtacggccatgcaatacctgcgggagattgaaatgcagtccactgccagggcggaccacgaggcgacgtcgtcgtcacgttttggcaagggggaaagaaagcagctgcgcgaacacgagcaaaccggtgatcaaagtgaatcaatggcgaagcggagtaccagctcgggaatgcaggtgggaactattgccgcgtctttggctatgaaagatagctcgaccgcgacgccggcttcgcaagggccgcaccggtctgggatggagctggataatatcgaagggactggagagagccgtacgcaatctcagcacgaaattgcgacacaacctattgccacaagcgcttttggttcaggtcatgatgtgatcattcctggagagggccagcctgaagaaacattcgacggcgcaccatattggatggtagaaagcggggatagcgagaccaatagccttccgtcgatccaacaaggcttatcttggccagggttagatgaccttgatttgctcgccgacagcagttcaccgctcagtactcaggttgttcctcctgacgtagccgctacgaatttaagcactgaggcagggtccgccagcgtcgaaagcacccaaatcctcgccgacagtgcctattccgacgacgcgaccgaaaccggtggccaaacagcttcaggatcgatccatgaaggttcagttcgttcgcttggctcaccggaggaacgcttcgacgcctttcccgagttgaccgacgaggacttggcgcagattgacgcattctcgcgagcccgctctccttcgaggcgagatgctgcgcacgctattcatgcggtcagcttggatgatgccttctcacgcaaggatcttgccgcgggccacgacggccggcttacgaatcctgcgttccgtcaggaggcttctctgcaggaatcgagcccatcagaaacgaagtccgacgacttcccggaattaaccgacgaggacctggcacggatcgacgcactctccgaagcccgctcaacttcgaggctggatgttgcacgcactattcatgcggtcaggttggaggcctctcggcaggacccgagcccatcagaaatgaagtccgacgacttccccgaattgaccaaagaggacttagcccggatcgacgcactctctggaccccgcccgactacggggcgggaaggtgcgaacactattcagccagtcaggttggacgatgctttctcagccgaagattataccgtgggccgcggcggccggcatacgaatcctgcgttccatgaggaagcttctcggcaggacccgagcccatcagagatgaagttcgatggcttgccggagttgaccgacgaggatctggtaaggattgacgcaatctctgaaccgcgctcgaagagatctcgctccgagcaggttgtcgggggaaaatctcataggctcaaactgaacgaggctatcgaggaggcgggctcgcccactaccgtttcgggaacaagcgccgccagggcggcacctatcacgctcgaaagcggagtacctaggttgccgcaggctacccatacggaacttcctggctcggacgttgcgggtccactgcggatcgggaaggcgtcgtgtgccgatatacggcgagatgtttcggataaagggaaacgaaaagtctcgtcagattatcagattcagcaaggtcctggcgcgtcctatgcttaccagccgcgacgcatgccgacggaagcgattttcgatgctgaacggcttggtgacgaagtgctcatcgggaatgagccagttccgcggtggccttacccctgggagcacgttgttcgttttgaaacaggcaagcagctcttcgaaagattgcagaagtggccgactgcggaggagttggaaaacagtgtgatcctcgtcaaagcggatagcgcgcaacgatcctatatgccccgaaatcagctgctcttgcatctcggatccgaaaagtattacgaacgaatgaaagcgctcggtctatccgataataccttcagcggattgaagtccgatagcaaatatttttatgatacacctgctggaccacgggtaagtgaacatgattatgagttcccgcggcaggcaggcgtgcataatccagaggtgatggttcagcatcatagcggaaccttcttcgcgttttggccaaaacttctcaggctggaaaagcttgcgacagtaacgaatacgtatggcgcggaaaatgtttggctcaaatcgccagccaatgcttacatgacgccggaaacctataattccaaggttgcgaacggcgccgaaaaccttttcatcgagttcctacgtcccgctcctgtccacgaccacctgcgggaacctggaacttcaaacgcaaaaactgttgacggacgaaacgaagatcgcgcgcaacaggccgaccggttagcagatcagtcgatgggccggaacggggacggccgtgacgcgcagggtggtaagagaaccttggaaccgcgcgtgcgcgaaaggtatgggctgtagatccagctgcccgtaaagcaaacagccgtccaataggataaacggagcgtggtcacgtgatgaattcaggcaagtacacgccaataggcctggctgcgagcatagcatgttcattggccgtggggttttgtgcggccagtctctatgtcacatttcgccatggctttacgggcgaaacgatgatgactttcaacgtttttgcgttcctgtacgagacaccgccttatttgggatacgcaagtcctacgttctatcgcggactagccatcatcgttgcgacgtcaacgctcgtgttgctatgccaactactgttatcgatgcgcgagcgcgaacatcacggcactgctcgctgggccggctccggcgagatgcggcacgccaggtacctccggcgctacagtcacgtcacgggtcccatcttcggcaagacatgtggaccacgttggtttggcagctacctaagtaacggagaacaacctcacagccttgttgtcgcgccaactcgcgctggtaagggtgtcggcgtcgttatcccgacgttgctaaccttcaagggctcagtaattgccttggatgtgaaaggcgagctatttgaactcacatcgagggcgcgtaaatcaagtggcgacgcggttttcaagttctcgcccttagatccagagcggcgaacgcattgttacaatcccgtgctggatattgccgcgttgccgcccgaacggcgctttacagaaacgcgccgcctcgctgcgaatctcatcacagccaaaggcaagggagccgaaggtttcatcgacggggcacgggatcttttcgtagcaggcatattgagttgcattgagcgcggcacaccaacgatcggtgccgtttacgatctgtttgctcagccgggtgaaaagtacaaactatttgcgcaactcgcggaggaaacacaaaacaaagaggctcagcgtatcttcgacaatatggcggggaatgacaccaaaatcctgacatcctacacatcggtgctcggcgacggcggactcaatctttgggccgatccactcgttaaagcggctacaagcacctcggatttttccgtctacgatctgcggcggaagaggacttgtatttatctttgtgtcagcccgaacgatctcgaagtcatagcgcccttgatgcgtcttctcttccagcaggttgtatcaatcctgcagcgatcgctgccacttggagatgaacggcacgaagttctgtttctcctcgatgagttcaagcacttgggcaagctggaagctgtggagacggcaattacgacgatcgccggctacaagggccgcttcatgtttattattcagagtctttcggctttgacaggaacttatgatgaagctggtaagcaaaattttctcagcaatacgggtgtgcaggtattcatggcgactgctgatgacgagacgcccaactacatttccaaagctatcggcgactacacattccaggctcgctcaacgtcgtacagccaagcgcgcatgtttgatcataacatccaaatctccgaccaaggagcaccgcttttgcgcgccgaacaagtccgcctactcgacgacgattatgaaatagtccttatcaaaggccaacctcccctcaaactgagaaaagtgcgatattattcggatttcatattgaagcgaattttcgaaagccaacacggttcccttcccgagcccgcatctttgatgttgccgggagacacaaacctcgttgaaggcaagctcgaccagggaacagccgatacaacttcgcaaaaaccggtgcagattgaagagaacgaccatggggaagtcgtttccccccaaaacagaactgtggctgatggagtaatgccaatagaagttcgcccccgttcaaacgaagttgatgacgagcgggaataccaaggcgcggacgccgcaacctctgagaagcttccggaaattgctccggctcttttggcgcagcgcgaactcctcgaccagatcatttcgctccagctacgaggtagaacagcctccggcacttgaagctcgatgtgataccgcttcggatcgagtcttgttagcgccgtcagatgtcccgtttcgggaatgcattaccaacgttgaaggttgccaattgatgagacatcgccatgaaaccgtcgggaagctcaaaaactggatacgccgggtcggctagatcctcgccccaggttcgcgcaggggttacgcctgtccttcatcccaaagagccttggaaccgttttgcttgctccccatctgacggccaaatggatcaccgggaaaatttatctgcgcaattcgcttacgatggaatgagactgggcgcagccgagcggtccgcgtacgagacatgggatagagcggaccggccgagttggaaagacctgatactgagcgctcgcctgaacgcgattgacagtttcgcttggaatgtcgatgtcggagaaagtacctcttcaacttttgtttatgatggtgttcctctggcggaaggggaacggcatgcctacgaggaatgggtggagccgggacagcccagttggcaacaactcgttgtgaacgcgcgtattgaagagctaaacacctctgctgcaattccgaatgagtgtagtccccttcaagaggaattccgatcggaggcgcctaagcgtaagcggacaagctccattggtcaaaagaacggtttccctgaaccattcgaatttgatgggatgagactcggctcgcctgagcgcgaagcatatgagaattggagtaaaccgcaaccgccatcctggaaagacctgatagttgacgcccgtcttgacgcaatcgacacctccacctggctcaacgaatcaaatgacacctcggtcttcgagtacgaaggcgtcccgcttggggagggggaacgcctagcatatgaaaaatggctcgagcccgcgcaaccaggatgggaagacctggttgtggacgcacgcgttgcggaattgcaccagtctgctccgacgtggtgcgaacaccaaccaggcaacgacgtttcttccaacgagtccgggcgcatctcgggcgtcccaattaacgccgagcaggtgtcgcgtgcgttcttcgtgtacgatggagtggcgctcggagcagccgagcgcgctgcgcatgatcgttggagcaggccggaccggcccacctgggaagatcttatcatagtcgcgcgccaagctgctatcgaaggcggtgccgtttcgaatgggatgatcgggaagacatcttcctcagtctttttatacgagggaatgttgcttggggatgcggagcgtcaggcgtacggacggtggaggcagctagcccagccgcggtggcaaaatctggtggtgaacgcgcgcctggcagagctcgacccggcggcctggattcccgatgaacatgatccgtctgaggatggcggggcgactggtcttctgtcgcaagcaagcacgaccaataagtcccgcctcagtttaggtgatcaaccggaagcgcgctcgcctagtctcgcacgtgagccagcacaacagccgactcacgtgcaaaacctgacgtgcgcacaattggaagcaagacgtgctctatatttcgggccctctgggagggatgcagaccaaaccgccagcatcgccgacagtaatcgcctcgacgaggtaagcaaagttaaacggctgggtgccaagagccgtcgaggcgctaaagcaacggcctatgacgtaatttcaagtgcggaaagactgtcgtctcacgagggttgtttgacggttcagtccactcagccagaaaaagccgcttgctcgagaagcgacaatatcggcacttatggaagtcgaaaaaacgaacgagctcggcttgcgaccgagaccgggaaatacgagtcggagcatattttcgggttcaaggttgtccacgataccctgcgctcgaccaaagagggccggcggctggaaaggcctatgcccgcctatctcgaatgcaaggaacttcatcgacaacatgttggtacgggaagggggcggacccgactggtggggcgcggctggccagatgacgcaagttaccgctcggatcaaagggcaactctatcggaccctgttgcgtccacggaaggtgcaacggcgtcaaacgggtatcaattaaaccagctaggctacgcacaccagctcgctaacgacgggctgcagagcgaaacgccagatggggttatcatgccgcttcaggtcgcgactactagctacaactatacggtaagccgcgatccggtactttctccgcccagtaaagagcaagctccggaattgttgcaccttgggccacgtggccagacagaagctgtactcgctcgcgaaacagcattgacaggaagatggccaacacgcgagcgtgagcagcaagtctatcgagagtttttagccctttatgacgtcaagaaggacctggaggccaagacacttgggttgcggaagaaaaaagctgcgcttgtttccgcgttgaaccggactgccgcctcaataggcacttcacccttgaaagcccaatcgtcgagcgcagaagttgaaaaagcaactcacgagtttgatgaacgacgggtttatgatccgcgcgatcgcggtcgggacaaagcattacaacggtgacaaagctggagatgaccatcgttagcggactttgtatcgatgcttaaaaatgatggttcagcatttgaaccgcaggctgtactgctactctttgaaatcccccgcaaaaaacgcgccgtagtgcaatcgatcgccagggcctgaatttcagttgaaacacgatgtccattcaacgccttaagcgcaggtgttagacttcgcatatccttgatccgcgttggagtgtgagttatgctcgaagacggccagaaaatgcaggaacgcgagctttcggtcctcggtggtgataagaccgaaagtgcagccaccttaccgaatgacattttggtggaagttgccaaacatctgccgaccgacgatccagtcgaaacggcagccaacctcacaagctttaaacttgcgagcccgtcggttcgggcatcggtcgatcagagcgatgtcggaacgttccaccgaagcgtaaatcgactgggtgcctcaagcaaggcattgtatgacctggctgtaccccggaacggctttgccgagtatccgaactatccggaaccggaccctgctggcgagtttgcgctggcgagccagcgcatcaggacaattggtccaactttgaagttccaatcgcccgccaggaaaacagcgatcgtcaatcacattctcaatatgtcggaaggcggtgagcaggcggaggcgattatgtcgatgacgtcccatttgagtgacctcgagagggccgacaagagacgccttatcgacagagcaattgaatacttcaaggtagacgggcctatcaactacgacagtcgccattatgcagcctacgcgattgcagcggcgcacaaccagttggaactcgaacacaagtcacaaatcttcgatgcaatggcgaagagaccccagcttgcgagactctacgccgacgaacgcatccatgcgcaggagcatttggggcttgcgtcgacatccgaaggtccgcacgagcggagcaataaacaactggccacggacattcttcagatcgaacaaaaaatccgcactgagctccttcccgaaactctcagtgctcacgaccagatggtaaaagcggaaggaatcgctggatcgattgagaaggcttaccgcgatgctcgcgcgaacttaacccgggcaccgcgagggaggtcaaattctgatctcagccggtagaacttggtctgaatattcgattatttctccgacgaaagcacttggttgacgagcgaatttttaaacgagcatcgataaagcgtgcacagggaaggcccacctaatggtcagtataaataaaaaagccccgcagaaatcttctacagcgaccacgcgcaattctgatgaacgcctggttgatcagttagggcaggcgtaccttgtggaacgcgaggcgcaggaaaggcgcgcgcgacttgaagcgccgccggcgttgaaaaaatatgcctcgaaactgcaactcctcaataagctcgatgcagatttccgtggtgtgatcgcccacaagccgtttcgcagcgagcaactgcgggtcgatagcaatggagaattgacccatagtcggggtctcataaaaaagaagaagaaggttttcattcgagatcaaacaactggctcccttcggcttattcactacgagaggtctgactggaatagtgtccgtcgctatgactacgaccagaacggcgtgttgagcgagaaacatatcaaaagcaaagccggtgccttcgaagaaaaatgggagcgggacgaaaacggtgaactgatgcgcacccgatacatcgatcggcgcagacttactggacgggcgttgcatcccatttccgaggaaatcggacgtccttatgagagtggcctggagaagaggctttatcgcgttttaacgcgtcgggagggctcccaacaaaagactttcgaacgcgatgacaagggtaatctggagctcattgcaagcaaacggatgggctattcgatgtcttcacaaaaggcaccggatcgacaaacatctagaacaagtatccgcaagcttggcggagctttcagtgaatcatatagatcccggctggataaggacggccacgagttaggtcgggatgtctccgcacatcgaagcctcctcaacaagcgttcagccgtctacgatgacgctacaggggagctaaagagcagcaagcacacgtttgggaagatatacaaagcggaagcgacatacctgaacgccgaaatcaaagaggtctccaaaaaaatcctcggagttacggtcggtaaagaattgaagacattaagtggacgcgaactcgaggctcaagtattacgtgccgcggaacgtgccctccataaacaggcctggcagcacccttcagctaacccctcgcggtcgcagcgggaaaataccaacagtcatcttggaaacgaacttgatgggccgctcgaatcggatatgaccgtcgtccatcaagccggatccgggttcgtcggcgacgatcgccacgttcatgatggcggtggatccaggttgaatgaattgcacgaatcgcgatcgtcgaatgatagggaaaagcttagttcgccgagagccgaaatttgcgaccgctcgatgaatcgggatcgcaccggctcaggtactttgtcgcgatgatagctaaactaggggggcacacaccgagttgtcaagtcgccccccggcaaatgagctcatccctgctgccatattcccaaactaccaacgtttcgcgtcaaactaggttcgcctaaaggcatgaaagtcgcgtttcaacgaacaggctcgatcgaaccagcgacccaacgttaatgattacaaactgcaaaccgtaacccttaaaggtaaacatttccaaagtttcatttgtagcgattttgaatttttcatgtgtagaagcgttcctgatatcaagttatagtcctcgcaatcgatccaccatagaaagattgctcatctgagcttaaggaattcaattcttcctcagatatacttggagccacgcgggccatctaactgacttctaggttttgatgaacaccatgtcccctcaatggctttgagaccgcaccggatgctcattgagttttgaaatcagcaccgttaccgaactttccatcctggctggctgatcacacacgattggaaagcgaggggaataggagtggcaagcatgccaaccgacgacattgtaatgtccgatcccggaatggctgctgttgacacgtctgtccctacgcgcttccagacagatcttcgccagttcagtaacctgctggacgagagcaatattgtggaatgggtcgtaaaccacgccgcaaatcgcaatgcgtgcttcggacaagaccaacttaagatttcggcggctcgggcactcacgcactacaaacggccggtacaagaaatcgacctgctattccaacaggtcgtcgcaagcgacaaactgacccggcttgattctccagatggccaacctctctacacctctacagagctgagagctgcggaacagaatactgtacgtcatgtcaccaatctttccgcagaagaaagcttcggcgttccgggaaccattgttgatatggtcgccgatagaggcattttcacaccggagctcagaggagcattacattatctgtctaggcgaaatcgagcttccactatggtgggcgtagcgggttccgcaaaaacaagtgtacttggagccctgaacgaagcggtggacaggttcaacgaggaagcgctcccgaccgagaaaataaagttgattgccttcgtacccaccaaccgggcggcccaggagcttcgtgagaaaggtcttcgcgacgtcgcgacgactttcaaggcgaaagaccgcaccatcggaaaaaataccatcgtcgtgatcgacgaaatgtcgatggccaagacgcaggagatcgcgcaactaatcgagacagttgcaaatgccacttcctatcacccaaccgaaaggccgaaactgatatgtgtgggagacgatcggcaactgccccctgttggacctggtgatctgcttccgattattatggagcaagccggctgctatgaactcgtccagccgcttcgacagctcgacgcgcggtcgcgaatagaaacagaaaagctcggacgtgacatacgacgcgatgccaagagcgccgtcgggcactatctcacagcgctcgaacaaatgggcctcgtccatttcgtatatgctcctcctagcggctcaaacgtcagggcgtcagaccagatcactgaccgcatgctggaggagatgaatagagtttgcgaccgatatccggtgtatgatcgtcttgtgatggcacactccaacaggagcgttaatcgcgccaatatcgctcttcatcagaggtttgttgacaaatccggattgcaagaccagcaaatgagtgtgtggtcaagcgtaatagatagtggaagttcggaatctggaatagatgagggttcgtcgagacgcgttcagcaaaggattaatctcgtcttgggagacaggattatattcagcgaaaaccgtctgcaagcggacatccgcaatggtacttttgcaactgtagtcggacttaatagcacagaagcttcccgagctgagaatggcacatctgctggggttcgcattactgcaaggttagacggatctggacgaaccgtcacttggaccgatagcgagtttaagggttttacctacggctatgctgctacaatttataagagtcagggggccacagttgatcacgccattctcctctgtgatggtgctctttcagataagctgacctatgtcggcctgacgaggcatcgcagtcgtctcgacgtcattgcttctcccctcgtggcaaacaatgttgaggctctcagtgcaaagctcactcagcaaagcgcgccaaataattccattcaattcccagcgctcgaacctgctgccttccaagagcgctcgtcggtttcgaacgcgcacttgctaaggccgctcgaccagatggaaatctctccaacgacgccgctttccttccaaggcagacaagaaagctccttcggggagaaccagctgcacgaaccatccacatcggatgtggaaatgccggaaagcgcggacctttacccgagcgccattgacttcgaagttttccagtcttctgtcatcacgactgaagagcaaatgcaaccggaattctgcgggtcggaatcgacggctaacacctcagcccacgaaagccaccaagtcacgatcgcaacggtaacaaacctggggatagcgatcgagaaacggaaacgagcggcggcaaaggaagaaatcgattctcgcaaaaaaatggcccgtcactcagttagttctgccgaggaagttgaagatatcacttccctgttcgaacgattgaaactggcaacctcggtcaccaacacagttcaaccgacgtatgcggacgtcgatcatatcatcggtactgatggccgagtgggtccaataccgcaccgggaagatgatccgggatcaaattgggaattgtcgtcaacgaacgccccctcaaacgtctcagagaaacgatcgaccaaagactcaggagaaaaaaatatggcttcgaatgaccagaaaatgcaaggcgctgactctgcaggcagcgagcgtcatttttcgcagacttccattgtggaagccctgcaggctggcgatcacaagaagctcgtggaaacgctcgccgcaaccggctcccttgtcgagaaggcggacgccgggtcggcgctgaaagcaatggcggatgcttacgaaagggatatcaaggcagatcccgaaaaggtccgcatgctctatgccaatcggcgcgttgatgtagatgcgctggccaaggagatcgaaaaacagggccttgcatccggtcgcctgagtggcgaccctgtcagcttcaaggcgttcaacaacaaggatatccgtttcagggtcggcgacaggctcagcgtcaccagcagctacaggaatctcattgccggtgaagccggccggatcgaaaagatcgaaggcaaatccgttaccttcaaacccgatggcagcagtcagagcaagaccttcgaggccagcaccggcgagccgggtgacaggggcgtcaagggctacaaaatcgaaggcccgatgacggtcatcggctccgcctatgaacttacgcgacatgatgacggcaaacgtgttgaccaaatctatctcttgaacgacgctgcccatggcatcaacgccaatagcgctttgctgagcaaggccgacgagcggacgcagcttttcacttcgctcaaggacaccgccgacagggacatcttggccaggcaactgggaaagccgggcagcgagctctaccaggacaaattcccagccttgccggactacacagccgccatcgatcggattgcaaaacgccaggaagttgtcgcggcacgtggcgaggagaaaacttccgccccgatagacctggcgccccaaacgccgcccgacgctgccgatgcggcagtcaataaccagaaaagaatcgtcgaggccttgcaggcaggcgaccacaagaagcttgtggaaacgctagccgcaaccggctcccttgttgagaacacaaatctcgtatcaacgttgaaagcgatagcgcagacttatgaaagagacattagtgcggaccccgagaaagtccgcgctctctacgccaacaaacgtgatcatgtagatttgcttgccgaagagatcgaaaagcagggccttgcatccggtcgcctgagtggcgaccctgtcagcttcaaggcgtttaacaacaaggatatccgtttcagggtcggtgacaggctcagcgtcactagcagctataggaatctcattgccggtgaagccggccggatcgaaaagatcgaaggcaaatccgttaccttcaaacccgatggcagcagtcagagcaagaccttcgaggccagcaccggcgagccgggtgacaggggtgtcaagggctataagattgaggggcccacgacaatcatcggctccgcctacgaaatcagaaatcacgacgatggcaggcgcgtcgatcaggtttatgtcttgcacagtgccattttcggctcaaatgccgcgagcgccctgttgagcaaggccgacgaacgaacccaggttttcaccgtgcaaagcgacacggctgacagacacatcttggccagccaactcagcaagcctggcagcgagctctatcaggacaaattcccagtctcgccggactacgcagccgcgatcgaccggatcgcgaaacgcgaggaacttagggccggacgtggcgaggaaagtcctactgttcaaatggagccggtgaaccaaacgccctacgaggcgggacattggacgcctgacagtcaaaaatctgtggtggaagccctgcaggctggcgatcacaagaagctcgtggaaacgctcgccgcaaccggctcccttgtcgagaaagcggacgccgggtcggcgctgaaagcaatggcggatgcttacgaaagggatatcaaggcagatcccgaaaaggtccgcatgctctatgccaatcggcgcgttgatgtagatgcgctggccaaggagatcgaaaaacagggccttgcatccggtcgcctgagtggcgaccctgtcagcttcaaggcgttcaacaacaaggatatccgtttcagggtcggcgacaggctcagcgtcaccagcagctacaggaatctcattgccggtgaagccggccggatcgaaaagatcgaaggcaaatccgttaccttcaaacccgatggcagcagtcagagcaagaccttcgaggccagcaccggcgagccgggtgacaggggcgtcaagggctacaaaatcgaaggcccgatgacggtcatcggctccgcctatgaacttacgcgacatgatgacggcaaacgtgttgaccaaatctatctcttgaacgacgctgcccatggcatcaacgccaatagcgctttgctgagcaaggccgacgagcggacgcagcttttcacttcgctcaaggacaccgccgacagggacatcttggccaggcaactgggaaagccgggcagcgagctctaccaggacaaattcccagccttgccggactacacagccgccatcgatcggattgcaaaacgccaggaagttgtcgcggcacgtggcgaggtcaagccgattgagcgcaccgaagcgcccgaaataccccaggttcaagctactatcgttggcgagacctcgatcattcggttgcccgatcggataaaaaccaatcgcgagaagccccaagaacttgatgtagtctcgaaagaagggcacgaaactacaggtagtctgaggcagagtgtccaagagagtaatgcagcaccaaaacagacttcgccgaaggcggcaaatgacgtggatcggctgacacgggattttgacgagcgcatccgcgtccgcggggatggacgtggactctaagtaaaagagggtgcgtaacgcgcaccctcttccactcgctgtccctgtatccgttctctgtcgcgagaacgtcgatcaccttttcggaactctttccagatctgcttgaggttccgttgccggagaaagcattggcgaggattgctgggatccggcggacggcgatgcgatgtgccggttcggtgaccaattccatcagagaccggccgacgtatggcctgccgaagtggaaacggctgatcagcttgcgaggccgagctacttccccggcaagcgtcgggttcggggcattgttttcctcgaccatggcggtattttgctgagttgcccggctaaactaggctttggcagcctgttctttgaactatgtacctcgcgaatgcatctagatccaatccaatatgcatggcatgccgaatccatgtgggagtttattcttgacacagatatttatgatataataactgagtaagcttaacataaggaggaaaaacatatgttacgcagcagcaacgatgttacgcagcagggcagtcgccctaaaacaaagttaggtggctcaagtatgggcatcattcgcacatgtaggctcggccctgaccaagtcaaatccatgcgggctgctcttgatcttttcggtcgtgagttcggagacgtagccacctactcccaacatcagccggactccgattacctcgggaacttgctccgtagtaagacattcatcgcgcttgctgccttcgaccaagaagcggttgttggcgctctcgcggcttacgttctgcccaagtttgagcagccgcgtagtgagatctatatctatgatctcgcagtctccggcgagcaccggaggcagggcattgccaccgcgctcatcaatctcctcaagcatgaggccaacgcgcttggtgcttatgtgatctacgtgcaagcagattacggtgacgatcccgcagtggctctctatacaaagttgggcatacgggaagaagtgatgcactttgatatcgacccaagtaccgccacctaataatgtctaacaattcgttcaagccgacgccgcttcgcggcgcggcttaactcaagcgttagatgcactatacgtaccaatccaaatcggatccccctgcagggctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagcagatctatcgatggtacctatctgcagacggaagggattcctgttaattaaaacagcttgcgtcatgcggtcgctgcgtatatgatgcgatgagtaaataaacaaatacgcaaggggaacgcatgaaggttatcgctgtacttaaccagaaaggcgggtcaggcaagacgaccatcgcaacccatctagcccgcgccctgcaactcgccggggccgatgttctgttagtcgattccgatccccagggcagtgcccgcgattgggcggccgtgcgggaagatcaaccgctaaccgttgtcggcatcgaccgcccgacgattgaccgcgacgtgaaggccatcggccggcgcgacttcgtagtgatcgacggagcgccccaggcggcggacttggctgtgtccgcgatcaaggcagccgacttcgtgctgattccggtgcagccaagcccttacgacatatgggccaccgccgacctggtggagctggttaagcagcgcattgaggtcacggatggaaggctacaagcggcctttgtcgtgtcgcgggcgatcaaaggcacgcgcatcggcggtgaggttgccgaggcgctggccgggtacgagctgcccattcttgagtcccgtatcacgcagcgcgtgagctacccaggcactgccgccgccggcacaaccgttcttgaatcagaacccgagggcgacgctgcccgcgaggtccaggcgctggccgctgaaattaaatcaaaactcatttgagttaatgaggtaaagagaaaatgagcaaaagcacaaacacgctaagtgccggccgtccgagcgcacgcagcagcaaggctgcaacgttggccagcctcgcagacacgccagccatgaagcgggtcaactttcagttgccggcggaggatcacaccaagctgaagatgtacgcggtacgccaaggcaagaccattaccgagctgctatctgaatacatcgcgcagctaccagagtaaatgagcaaatgaataaatgagtagatgaattttagcggctaaaggaggcggcatggaaaatcaagaacaaccaggcaccgacgccgtggaatgccccatgtgtggaggaacgggcggttggccaggcgtaagcggctgggttgcctgccggccctgcaatggcactggaacccccaagcccgaggaatcggcgtgagcggtcgcaaaccatccggcccggtacaaatcggcgcggcgctgggtgatgacctggtggagaagttgaaggcagcgcaggccgcccagcggcaacgcatcgaggcagaagcacgccccggtgaatcgtggcaagcagccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggcaggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctagctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagccgaagagctgcaaaaagcgcctacccttcggtcgctgcgctccctacgccccgccgcttcgcgtcggcctatgcatataattgtggtttcaaaatcggctccgtcgatactatgttatacgccaactctgaaaacaactttgaaaaa

What is claimed is:

1. A method of producing a transformed plant cell, the method comprising:
   a. contacting a plant cell with an *Ochrobactrum* haywardense H1 comprising in operable linkage a first nucleic acid, wherein the first nucleic acid comprises a vir gene region, and a second nucleic acid, wherein the second nucleic acid comprises one or more T-DNA border sequence(s) operably linked to a sequence of interest;
   b. culturing the plant cell under conditions allowing Ochrobactrum to transfer the sequence of interest to the plant cell; and
   c. identifying a transformed plant cell comprising the sequence of interest in its genome.

2. The method of claim 1, further comprising regenerating a plant comprising the sequence of interest in its genome.

3. The method of claim 1, wherein the plant cell is from a monocot or a dicot.

4. The method of claim 1, wherein the plant cell is from a plant selected from the group consisting of soybean, tobacco, sunflower, *Arabidopsis*, safflower, alfalfa, corn, wheat, rice, barley, oats, millet, canola, *Brassica*, cotton, and sugarcane.

5. The method of claim 1, wherein the *Ochrobactrum* is grown in the presence of acetosyringone or other compound that induces vir or r-vir gene function prior to contacting the plant cell.

6. The method of claim 1, wherein the plant cell is comprised in an explant from a plant seed, seedling, callus, cell suspension, cotyledon, meristem, leaf, root, or stem; and the explant is contacted with the *Ochrobactrum*.

7. The method of claim 6, wherein the explant comprises an embryonic meristem, a somatic meristem, callus, cell suspension; a cotyledon, a cotyledonary node, or comprises tissue from a leaf, a root, or a stem.

8. The method of claim 1, wherein identifying a plant cell comprising the sequence of interest is carried out in the absence of a selection agent.

9. The method of claim 1, wherein identifying a plant cell comprising the sequence of interest comprises culturing the plant cell in the presence of a selection agent, wherein the sequence of interest confers tolerance to the selection agent or is co-delivered with a selectable marker that confers tolerance to the selection agent.

10. The method of claim 9, wherein the selection agent is chlrosulfuron, ethametsulfuron, imazaphyr, glyphosate, kanamycin, spectinomycin, bialaphos, 2,4-D, or dicamba.

11. The method of claim 9, wherein the sequence of interest is not physically linked to a selectable marker gene.

12. The method of claim 11, wherein the marker gene and the sequence of interest genetically segregate in progeny of a plant regenerated from the plant cell comprising the sequence of interest.

13. The method of claim 1, wherein the *Ochrobactrum* further comprises a third nucleic acid comprising a second sequence of interest, and whereby the transformed cell comprises the second sequence of interest in its genome.

14. The method of claim 2, wherein regenerating a plant from the plant cell comprises inducing formation of one or more shoots from an explant comprising the plant cell and cultivating at least a first shoot into a whole fertile plant.

15. The method of claim 14, wherein regeneration occurs by organogenesis.

16. The method of claim 1, wherein the *Ochrobactrum* further comprises a selectable marker.

17. The method of claim 16, wherein the selectable marker provides resistance to gentamicin, neomycin/kanamycin, hygromycin, or spectinomycin.

18. The method of claim 17, wherein the selectable marker gene is an aacC1 gene, a npagene, a npt2 gene, a hpt gene, a SpcN gene, an aph gene or an aadA gene.

19. The method of claim 16, wherein the selectable marker gene is not a tetracycline selectable marker gene.

20. The method of claim 19, wherein the selectable marker gene is not a tetAR gene.

21. The method of claim 1, wherein the vir gene region comprises Rhizobiaceae virulence genes virB1-virB11 having SEQ ID NOS: 4-14, respectively, or r-virB1-B11 having SEQ ID NOS: 80-90, respectively, wherein the vector comprising the virulence genes r-virB1-B11 further comprises a r-galls virulence gene having SEQ ID NO: 101.

22. The method of claim 1, wherein the vir gene region comprises Rhizobiaceae virulence genes virC1-C2 having SEQ ID NOS: 16-17, respectively, or r-virC1-C2 having SEQ ID NOS: 92-93, respectively, wherein the vector comprising the virulence genes r-virC1-C2 further comprises a r-galls virulence gene having SEQ ID NO: 101.

23. The method of claim 1, wherein the vir gene region comprises Rhizobiaceae virulence genes virD1-D2 having SEQ ID NOS: 18-19, respectively, or r-virD1-D2 having SEQ ID NOS: 94-95, respectively, wherein the vector comprising the virulence genes r-virD1-D2 further comprises a r-galls virulence gene having SEQ ID NO: 101.

24. The method of claim 1, wherein the vir gene region comprises Rhizobiaceae virulence gene virG having SEQ ID NO: 15, or a r-virG virulence gene having SEQ ID NO: 91, wherein the vector comprising the virulence gene r-virG further comprises a r-galls virulence gene having SEQ ID NO: 101.

25. The method of claim 1, wherein the vir gene region comprises one or more Rhizobiaceae virulence genes virA, virD3, virD4, virD5, virE1, virE2, virE3, virH, virH1, virH2, virK, virL, virM, virP, virQ, r-virA, r-virD3, r-virD4, r-virD5, r-virE3, or r-virF or variants, wherein the vector comprising the virulence genes r-virA, r-virD3, r-virD4, r-virD5, r-virE3, or r-virF further comprises a r-galls virulence gene having SEQ ID NO: 101.

26. The method of claim 25, wherein the Rhizobiaceae virulence gene is virA having SEQ ID NO: 26, or a r-virA virulence gene having SEQ ID NO: 79, wherein the vector comprising the virulence gene r-virA further comprises a r-galls virulence gene having SEQ ID NO: 101.

27. The method of claim 25, wherein the Rhizobiaceae virulence genes virD3-D5 have, respectively, SEQ ID NOS: 20-22, or the r-virD3-D5 virulence genes having SEQ ID NO: 96-98, respectively, wherein the vector comprising the virulence gene r-virD3-D5 further comprises a r-galls virulence gene having SEQ ID NO: 101.

28. The method of claim 25, wherein the Rhizobiaceae virulence genes virE1-E3 have, respectively, SEQ ID NOS: 23-25, or a r-virE3 virulence gene having SEQ ID NO: 100, wherein the vector comprising the virulence gene r-virE3 further comprises a r-galls virulence gene having SEQ ID NO: 101.

29. he method of claim 25, wherein the Rhizobiaceae virulence genes virH-H2 have, respectively, SEQ ID NOS: 42-43.

30. The method of claim 25, wherein the Rhizobiaceae virulence gene virK has SEQ ID NO: 45.

31. The method of claim 25, wherein the Rhizobiaceae virulence gene virL has SEQ ID NO: 46.

32. The method of claim 25, wherein the Rhizobiaceae virulence gene virM has SEQ ID NO: 47.

33. The method of claim 25, wherein the Rhizobiaceae virulence gene virP has SEQ ID NO: 48.

34. The method of claim 25, wherein the Rhizobiaceae virulence gene virQ has SEQ ID NO: 49.

35. The method of claim 25, comprising the Rhizobiaceae virulence genes virD3-D5 and virE1-E3, or r-virD3-D5 and r-virE3, wherein the vector comprising the virulence genes r-virD3-D5 and r-virE3 further comprises a r-galls virulence gene having SEQ ID NO: 101.

36. The method of claim 25, comprising the Rhizobiaceae virulence genes virA, virD3-D5, and virE1-E3, or r-virA, r-virD3-D5, and r-virE3, wherein the vector comprising the virulence genes r-virA, r-virD3-D5, and r-virE3 further comprises a r-galls virulence gene having SEQ ID NO: 101.

37. The method of claim 1, wherein the *Ochrobactrum* further comprises an origin of replication for propagation and stable maintenance in *Escherichia coli*.

38. The method of claim 37, wherein the origin of replication for propagation and stable maintenance in *Escherichia coli* is derived from a Col E1, pSC101, p15A, or R6K origin of replication.

39. The method of claim 38, wherein the origin of replication for propagation and stable maintenance in *Escherichia coli* is derived from a Col E1 origin of replication.

40. The method of claim 39, wherein the origin of replication for propagation and stable maintenance in *Escherichia coli* is derived from the ColE1 origin of replication has SEQ ID NO: 2.

41. The method of claim 1, wherein the *Ochrobactrum* further comprises an origin of replication for propagation and stable maintenance in *Ochrobactrum* sp.

42. The method of claim 41, wherein the origin of replication for propagation and stable maintenance in *Ochrobactrum* sp. is a low copy number origin of replication.

43. The method of claim 41, wherein the origin of replication for propagation and stable maintenance in *Ochrobactrum* sp. is derived from a pRi, pVS1, pRFS1010, pRK2, pSa, or pBBR1 origin of replication.

44. The method of claim 43, wherein the origin of replication for propagation and stable maintenance in *Ochrobactrum* sp. has SEQ ID NO: 3, 37, 38, 53, 57, 58, 59, 60, or 112.

45. The method of claim 37, wherein the origin of replication for propagation and stable maintenance in *Escherichia coli* and the origin of replication for propagation and stable maintenance in *Ochrobactrum* sp. are the same origin of replication.

46. The method of claim 45, wherein the origin of replication is derived from a pRK2 origin of replication, from a pSa origin of replication, or a pRFS1010 origin of replication.

47. The method of claim 46, wherein the origin of replication is derived from the pRK2 origin of replication.

48. The method of claim 47, wherein the pRK2 origin of replication has SEQ ID NO: 38.

49. The method of claim 46, wherein the pRK2 origin of replication is a mini or micro pRK2 origin of replication.

50. The method of claim 49, wherein the pRK2 origin of replication is a micro pRK2 origin of replication.

51. The method of claim 50, wherein the micro pRK2 origin of replication has SEQ ID NO: 54.

52. The method of claim 49, wherein the pRK2 origin of replication is a mini pRK2 origin of replication.

53. The method of claim 52, wherein the mini pRK2 has SEQ ID NO: 66.

54. The method of claim 46, wherein the pRK2 origin of replication comprises the trfA and OriV sequences.

55. The method of claim 54, wherein the pRK2 origin of replication comprises SEQ ID NOS: 64 and 65.

56. The method of claim 45, further comprising a sequence derived from the par DE operon.

57. The method of claim 56, wherein the par DE operon has SEQ ID NO: 55.

58. *Ochrobactrum* haywardense H1, comprising:
a first vector comprising in operable linkage:
a) an origin of replication for propagation and stable maintenance in *Escherichia coli;*
b) an origin of replication for propagation and stable maintenance in *Ochrobactrum* sp.
c) a selectable marker gene; and
d) Rhizobiaceae virulence genes virB1-B11 or r-virB1-B11, virC1-C2 or r-virC1-C2, virD1-D2 or r-virD1-D2, and virG or r-virG, wherein the vector comprising the virulence genes r-virB1-B11, r-virC1-C2, r-virD1-D2, and r-virG further comprises a r-galls virulence gene, having SEQ ID NO: 101; and
a second vector comprising in operable linkage one or more T-DNA border sequence(s) operably linked to a sequence of interest.

59. The Ochrobactrum of claim 58, wherein the Rhizobiaceae virulence genes are virB1-virB11 having SEQ ID NOS: 4-14, respectively, or r-virB1-B11 having SEQ ID NOS: 80-90, respectively.

60. The *Ochrobactrum* of claim 58, wherein the Rhizobiaceae virulence genes are virC1-C2 having SEQ ID NOS: 16-17, respectively, or r-virC1-C2 having SEQ ID NOS: 92-93, respectively.

61. The *Ochrobactrum* of claim 58, wherein the Rhizobiaceae virulence genes are virD1-D2 having SEQ ID NOS: 18-19, respectively, or r-virD1-D2 having SEQ ID NOS: 94-95, respectively.

62. The *Ochrobactrum* of claim 58, wherein the Rhizobiaceae virulence gene is virG having SEQ ID NO: 15, or a r-virG virulence gene having SEQ ID NO: 91.

63. The *Ochrobactrum* of claim 58, further comprising one or more of Rhizobiaceae virulence genes virA, virD3, virD4, virD5, virE1, virE2, virE3, virH, virH1, virH2, virK, virL, virM, virP, virQ, r-virA, r-virD3, r-virD4, r-virD5, r-virE3, or r-virF.

64. The *Ochrobactrum* of claim 58, wherein the origin of replication for propagation and stable maintenance in *Escherichia coli* is derived from a Col E1, pSC101, p15A, or R6K origin of replication.

65. The *Ochrobactrum* of claim 64, wherein the origin of replication for propagation and stable maintenance in *Escherichia coli* is derived from a Col E1 origin of replication.

66. The *Ochrobactrum* of claim 65, wherein the origin of replication for propagation and stable maintenance in *Escherichia coli* is derived from the ColE1 origin of replication has SEQ ID NO: 2.

67. The *Ochrobactrum* of claim 64, wherein the origin of replication for propagation and stable maintenance in *Escherichia coli* is derived from a pSC101 origin of replication.

68. The *Ochrobactrum* of claim 67, wherein the origin of replication for propagation and stable maintenance in *Escherichia coli* is derived from the pSC101 origin of replication has SEQ ID NO: 50.

69. The *Ochrobactrum* of claim 64, wherein the origin of replication for propagation and stable maintenance in *Escherichia coli* is derived from a p15A origin of replication.

70. The *Ochrobactrum* of claim 69, wherein the origin of replication for propagation and stable maintenance in *Escherichia coli* is derived from the p15A origin of replication has SEQ ID NO: 51.

71. The *Ochrobactrum* of claim 64, wherein the origin of replication for propagation and stable maintenance in *Escherichia coli* is derived from a R6K origin of replication.

72. The *Ochrobactrum* of claim 71, wherein the origin of replication for propagation and stable maintenance in *Escherichia coli* is derived from the R6K origin of replication has SEQ ID NO: 52.

73. The *Ochrobactrum* of claim 58, wherein the origin of replication for propagation and stable maintenance in *Ochrobactrum* sp. is a high copy number origin of replication.

74. The *Ochrobactrum* of claim 58, wherein the origin of replication for propagation and stable maintenance in *Ochrobactrum* sp. is an intermediate copy number origin of replication.

75. The *Ochrobactrum* of claim 58, wherein the origin of replication for propagation and stable maintenance in *Ochrobactrum* sp. is a low copy number origin of replication.

76. The *Ochrobactrum* of claim 58, wherein the origin of replication for propagation and stable maintenance in *Ochrobactrum* sp. is derived from a pRi, pVS1, pRFS1010, pRK2, pSa, or pBBR1 origin of replication.

77. The *Ochrobactrum* of claim 76, wherein the origin of replication for propagation and stable maintenance in *Ochrobactrum* sp. is a variant of the pRK2 origin of replication.

78. The *Ochrobactrum* of claim 76, wherein the origin of replication for propagation and stable maintenance in *Ochrobactrum* sp. is derived from the pRFS1010 origin of replication.

79. The *Ochrobactrum* of claim 76, wherein the origin of replication for propagation and stable maintenance in *Ochrobactrum* sp. is derived from the pVS1 origin of replication.

80. The *Ochrobactrum* of claim 76, wherein the origin of replication for propagation and stable maintenance in *Ochrobactrum* sp. is derived from the pSa origin of replication.

81. The *Ochrobactrum* of claim 76, wherein the origin of replication for propagation and stable maintenance in *Ochrobactrum* sp. has SEQ ID NO: 3, 37, 38, 53, 57, 58, 59, 60, or 112.

82. The *Ochrobactrum* of claim 58, wherein the origin of replication for propagation and stable maintenance in *Ochrobactrum* sp. is a repABC compatible origin of replication.

83. The *Ochrobactrum* of claim 82, wherein the repABC compatible origin of replication has SEQ ID NOS: 57, 58, 59, or 60.

84. The *Ochrobactrum* of claim 58, wherein the origin of replication for propagation and stable maintenance in *Escherichia coli* and the origin of replication for propagation and stable maintenance in *Ochrobactrum* sp. are the same origin of replication.

85. The *Ochrobactrum* of claim 84, wherein the origin of replication is derived from a pRK2 origin of replication, from a pSa origin of replication, or a pRFS1010 origin of replication.

86. The *Ochrobactrum* of claim 85, wherein the origin of replication is derived from the pRK2 origin of replication.

87. The *Ochrobactrum* of claim 86, wherein the pRK2 origin of replication has SEQ ID NO: 38.

88. The *Ochrobactrum* of claim 85, wherein the origin of replication is derived from the pSa origin of replication.

89. The *Ochrobactrum* of claim 88, wherein the pSa origin of replication has SEQ ID NO: 53.

90. The *Ochrobactrum* of claim 85, wherein the origin of replication is derived from the pRFS1010 origin of replication.

91. The *Ochrobactrum* of claim 90, wherein the pRFS1010 origin of replication has SEQ ID NO: 37.

92. The *Ochrobactrum* of claim 85, wherein the origin of replication is derived from the pRK2 origin of replication.

93. The *Ochrobactrum* of claim 92, wherein the pRK2 origin of replication is a mini or micro pRK2 origin of replication.

94. The *Ochrobactrum* of claim 93, wherein the pRK2 origin of replication is a micro pRK2 origin of replication.

95. The *Ochrobactrum* of claim 94, wherein the micro pRK2 origin of replication has SEQ ID NO: 54.

96. The *Ochrobactrum* of claim 93, wherein the pRK2 origin of replication is a mini pRK2 origin of replication.

97. The *Ochrobactrum* of claim 96, wherein the mini pRK2 has SEQ ID NO: 66.

98. The *Ochrobactrum* of claim 92, wherein the pRK2 origin of replication comprises the trfA and OriV sequences.

99. The *Ochrobactrum* of claim 98, wherein the pRK2 origin of replication comprises SEQ ID NOS: 64 and 65.

100. The *Ochrobactrum* of claim 84, further comprising a sequence derived from the par DE operon.

101. The *Ochrobactrum* of claim 100, wherein the par DE operon has SEQ ID NO: 55.

102. The *Ochrobactrum* of claim 58, wherein the selectable marker provides resistance to gentamicin, neomycin/kanamycin, hygromycin, or spectinomycin.

103. The *Ochrobactrum* of claim 102, wherein the selectable marker gene is an aacC1 gene, a npt1 gene, a npt2 gene, a hpt gene, a SpcN gene, an aph gene or an aadA gene.

104. The *Ochrobactrum* of claim 103, wherein the selectable marker gene is an aacC1 gene.

105. The *Ochrobactrum* of claim 104, wherein the aacC1 gene has SEQ ID NO: 1.

106. The *Ochrobactrum* of claim 103, wherein the selectable marker gene is an aadA gene.

107. The *Ochrobactrum* of claim 106, wherein the aadA gene has SEQ ID NO: 39.

108. The *Ochrobactrum* of claim 103, wherein the selectable marker gene is a npt1 gene.

109. The *Ochrobactrum* of claim 108, wherein the npt1 gene has SEQ ID NO: 40.

110. The *Ochrobactrum* of claim 103, wherein the selectable marker gene is a npt2 gene.

111. The *Ochrobactrum* of claim 110, wherein the npt2 gene has SEQ ID NO: 41.

112. The *Ochrobactrum* of claim 103, wherein the selectable marker gene is a hpt gene.

113. The *Ochrobactrum* of claim 112, wherein the hpt gene has SEQ ID NO: 67.

114. The *Ochrobactrum* of claim 58, wherein the selectable marker gene is not a tetracycline selectable marker gene.

115. The *Ochrobactrum* of claim 58, wherein the selectable marker gene is not a tetAR gene.

116. The *Ochrobactrum* of claim 58, wherein the selectable marker gene is a counter-selectable marker gene.

117. The *Ochrobactrum* of claim 116, wherein the counter-selectable marker gene is a sacB gene, a rpsL (strA) gene, a pheS gene, a dhfr (folA) gene, a lacY gene, a Gata-1 gene, a ccdB gene, or a thyA- gene.

118. The *Ochrobactrum* of claim 58, wherein the first vector does not comprise SEQ ID NO: 61.

119. The *Ochrobactrum* of claim 58, wherein the first vector does not comprise SEQ ID NO: 62.

120. The *Ochrobactrum* of claim 58, wherein the first vector does not comprise a tra operon sequence or a trb operon sequence.

121. The *Ochrobactrum* of claim 120, wherein the first vector does not comprise SEQ ID NO: 63.

122. The *Ochrobactrum* of claim 58, wherein the first vector has SEQ ID NO: 34.

123. The *Ochrobactrum* of claim 58 wherein the first vector has SEQ ID NO: 35.

124. The *Ochrobactrum* of claim 58, wherein the first vector SEQ ID NO: 36.

* * * * *